United States Patent 12,648,973 (ACTIVE SUBSTANCE OF Lactobacillus plantarum GKM3, A COMPOSITION COMPRISING THEREOF AND ITS USE FOR PROMOTING LONGEVITY) - sequence listing, part 3

SEQ ID NO: 2 - DNA, 3211022 bp, Lactobacillus plantarum (residues 1-1,605,511 of 3,211,022)
aggcttttaactgacataactagcctctgtataagcaaatgggacgagaaaccgaattttggtttctcgtcccatttgcttacgcctttgatttttaaagttggtccctaccgtgaccaatttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgaccagtttctggagctgaaagtaattctcgttgtttcgatttgaaatattcccaattttcgttcacggaaatccttttaagatatccttttggtgttagtgccgcggcaattagttgatgattttcatcatacttttcggcaatgtattctttaaagtcacgggtaaaaccatacttatcagtccgttgacgataagcattaaaattaaaccggacgttttgcggattgataaaataatcatctttttcatgatagtcccagttcataaccttacggtcatcactttgccattttcgactattctctttaagcattgtgccgtagggaatcaaaacggtatgctgaccgaattcatcttccaagtaccgataattactttcggaaccgtatccggcatcggcaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcgggttttaattgaccgttttgcatcggatcttccttgacccgcataaaggtggcatcgtgatccgtcttagagtagctgttacgctgaccatagattgcttgctgtgcttggtgttcacgcattttatcacgtcgtttatccaacttacgtttttgtgatttaacagtccggcgttgctgtttggctgggttcggggggaaacccgcttagttgcttccacggtttcattaaggaccactaagtgatcctcaaccttgctaatcatgatatccaatagttcgggagtcagctctgatcccgccggaatttcaccgacaattttagcttcatgaagctcgcctaacagatcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagctatcggttgtcaaagtggccagttcatcagaaattctaaagcgacaaatcgtccggtaggacggaatttggtcggcaattaaccacccagctggcttgttttcacgggcaaactgttcaattttacgactgctgaaaatgccatagcagtatgctaaaaggaccagttttaacatggcaccgaggttatattcccgcggacggccaaactggtaatcatattttagttttaaactctcaacaagttggttgatgtaacgagcaggatgatgctcttctggttggtaatccaaggcgatactcaaagtggtttgattcatgttataataatcttgcatattaggaatgtcctttcgaggataatttcgtagagtatcgggtgcgaccgatgcttttttttattttctattatatcaaaaacaggtctggaaaaatccgaagatttttccagacctgttttgtttctagagacttatgtcacagcctctctttgctttttcattgaaacattctccgccttggtttactttagtattcttttaagtaacgtgttcttgatataaacaaaattctcttgacgatgatagataacaataatgattactatcataaacattacaatcaaaacaacattaatgattgcgatagccaacgctggccaattcaaatacgtatctatccctaaaaataagccaagccaatgcaccaatcatccctcccatcaagaccaaattgccaaaataagtttttaaatagaaggtcttaaactgacctttaattacaaatcccttttggaagataattaatggctcaaaccaagagttaacaaagggttagtcaaaatcgttccaatcaggacaccctttatgccaagatgaaagacggtcagtaagatgagcgataaaataaaattaatcaacgcttcaactactgactttttaccgtttggtacaaacaatccatatgcagaaacgaatacaatcgaagactgtcgcaactgatcaatgaagtaatttaagacaatcacaatcacggtgctgctggtcagcacatagtttttcccgcccaagcctcgcacaaacgggttcaaggcaaccaacaaacaagctgcagtaattgtcgtcataactaaattaatataaaaatgagtcttgtatataaaaaggcttttcgttgcgtccttcttctgcaatcaaattaccaatacttgctgttactgaactaactaactttgataagattgtactaacactggtcacaatcaataaataatttgaataaataccgacgattgccaaccccataaatgctgataataatagattatcggtggagcgtaccacgatactcccaatccgtgatccgaccatgccaataatattattgcgaatctgtctgatatcgaatctacttaatcgtaatttagtgttttccttgagatagggatactcacgattcaccagtgccgaaatagccaagttagaaattagtgtacaaatggtcgcgacaatcaaataaagtgaataggccttaaagaagtataagacaataatttgtagtatggtctgtaataaggtgtacttgaaagtgttcatagaactcttgtattctttttgatctgcaatcaagatagaacgcttatacgtaaaaaaataacttacgactgaattactcaaatatagcaaaaaaaaattggaatatgttcgatatcaccataattttttatgatatatggaaacaatggaatcaaaccaactccaagtactaaaatagctagcccgataccagtataggcacgctttataaagttcatcagtgcagatattttcttataattcctatcataaattggcttatatagcgaaaagacaattgaagtcccgacaccaagctctgcaaatgataaataagtcagtaaattagtgaacagaccatttaaacccaaaaactctttacccaatacctgaataaagaatgtctgattgacaaaccgcaaaataattgtcagcacttgtaataatgttaagactgttgagttgacaaacgcctttctccaacggccagttgttttctctcccattatgcaaattacctttcaaaatctgattgttgcgcaaacttttcatttagcgcgcaaactaacttggtcttcttatcaacataatcagttgtatcagcatcattaacacaaaccaaatggtgcttggaatgcgttaattcattaattagtgcgtgagtctgatttaacgtgtaatacgcatcaaatttaggactctttggcgcaaaggcccctttttccaagcggaaatatcgtatcaagtataccgtgacgtcatcgcgcgttctgaaacggtggctcacggtttgctgtatttttgttgccacatttttttagctgctcgatactctgattttgtaaatgaataggcgttatggtacagcacataattcgagactcgaccaccattacgaactatttggactaaattcttgatatttcctctaagtccatatgttcgtgaaaacatgccattaacgctctgccgttgtcccttcagccactgattaatgcagagtatgttattgaataacagaaaatcaaaatcgctgtttggaatcaaccgactataaatacgaaaatcacgtggtaacccattcttgaaaaaatcagtgggtacaacgttccttatttatcaaaaatcatcattaaaatagacaaattgttctgacagtccaggaattcggtctaaacaaaaatcaatagcattggaattaaacgttggtagcgctgcggctggtataatatcttgatgatcgattacagtcagccgtggattgctcgtactcaaccaatttggacgctgatggtcagtgactaaatagatatgattcacccagttggcatacttttcaattgatcgtaataaataacgaagcgttccatagtcacgaaaccgttcgtccccattgctgctattcacaattttctttccagaataagcctgtttcttttttgccattctgagtcctctgaatcaacccagctaataacaaaatcaattttatccaaataatccacctcctataacagtttatttagtagcttggcagttcgccgataatagacgtcctcatatagattggtaatactttgttttacttgagctgctggaaaatgaaccttctctatccacaaacttttgcataatagctgcaaattgcattacatcacgattattgattaaaaagccattatttttattgatgatgtcagccggaccaactggacaatcaaatgatatagctggaatcccccgacttatcgcttctgcaagaaccatcccaaaaccctcagaagttgagctcaggacaagagcatccgcatgttcaattttctcccatacattggtaacccaaccatgccaaataatgtgtgattcaatttgtaatttttgatataaactacacactgtcgatattcatcctgagtcgcagtcgtatctgttccatagatgtgtaatttccaagcgcccttcagctgcacacaggcatcaaataaggcttgcatgttcttttgttgattaaactgaatacgagcaacataaataaaactcactacctgattttcaggtaaaataatttgattgcttttaggtatggggttatagattaaatgaattcggggactgattaattccaatatccatcaactgttgttgaatcccaccactaatcgccaaatgttcatccgccaacgctaaatagctttgatcacgagtcgaaaaataatcatttatcgaaaattgaacccatgagatgagtttaaaatggcgaaagtacagttttctggcaagattgatcaaaaacaacaatctaggcgtaaatacaattactgcatcagaatggcaccggcatatgtgcgggagcagcttaccggccttagttattctccttgtccctgcggtaccaattgtaattttagtacgcttatcaagctgcttgagccacacagaatcacccatgacttgtgacacatacaactcaaaatcatacgtattggcaaggtgattaataaaactcgtaattacgctttcttctccgccgtgacccgccatcggcccagtcacaatcataatcttcttctttgacgtcatctgatttcctctcaaaactaaactctggataaacaaatcaataccattaatactgcaactggacattgatatggaataagcaattgattctctgaaataccggaaattaaataaatcaaaaatagcgccaataacgcatactgcctatgccaaataattttcttaaacgccaccattaacaatcctatcgtgctaacgaaagcgagcaacccattaatgattggaaagaagatgaattccccatcaaatgcgcctcggccgactgtccaatttaccccggtgagcacgacatctgccaactgatttccaaataaattcatttgataattagctaaatagtagttccagatagaaggtctgctcgtaaaaatatcatttaactgtgacaaaaatggataattgttgaaattgtgcccaatccaaagacacactccgaagaaaattactggtaataggactaaaccataactgaaccatctagatctcaaaaagtgtacgagaactggtgagccggctttcatgagaatgccaacacaagaacaatcaataaaagtgctgtaaaatcttccaacataagtagtaagactatcgcagcaggggatctcgcaccaattaattaacgataatttactccagttgagtgtccaatgcatgatgaccatacatgcacaataaaatccggtcgtatttggatttctgaatccgatggctaacaacccatattttgcttcgtaaattggtagaactttcaatactaccaaaccaatcacaacaacacaggcaataaaaaaagagactaaataaactttcaacactaatcggacgtccattatattgatggtatataaccccaacaagaagataatggccacattcaaatttccttttcccagatagaagaacattaatatgctcaatacaaacaaatataaccattgcttaactttttgggtttggccgacctgttgaagaataaacagtgtataaagcacaatatacattccataaactaggtactgccaaaaccttgaaacaaagactaatttaaatgagctattgtaaatagtcatataaatcagaaatacagccaatggtagtacactcagttgtttttttgataatttcatacgttcttcctttgcaataaggtacagtcaagcttactcgccagctcgttcaaaacttgaagtctttggaaaacggcgcttaaataggctaataatttttgtaaatcacggtcagttgcatcgatggtatcattaacgttagtaatttttacctttttatgttcaaacaacagctgttcagttttttcaggattatccgtgttggcagtctgaccaaaatacatactccgaacgtcaacatgtccaagaataatctggtaatagcgtacaaactgaatggaataatcatctgaggtacgaaatttttcggaaaagtttgccattagttctggctccagttggcgataagccgcttccatatctgatttaataaatgaataggcagtatgtgcatcgtataatctccgtaaatctcggaaaaacgcttaagaatgcattcaacaaaaacacagataagccttgtctgaccgagaaaaactgcttccattcctttttcagcacttcacgcttattaactaattgattaattttcatcgtgttattcaccaacgtatgatcgtacccttcaattggcataataattgattgaccaaccgtatcacgtgccttcccatcccttgaaaagaaatcttccgggtgaacaggctgattaataaaaaagtcatcattaaaataaacaaaatgatcactcagccccgaaatcttaaataaattccaatcaatagtattggaatcaaaagttggtaaaaattgtttgtcgataatctcactgtgatcaataatcttaattttgggattgtccaaatttagaaaatctggtatttgatgatccgtgacaatatatattttgtggacccaactcgcattttgttcaatagaacgaaaccaatacttaaaaagtcccaaaaatcacgataacgattctgggcaatttcatcattttgacgacttttcggctgctttcgttcatacttagactttttccgttgccattcttcatcatggttattaacccaggtcactacaaaatcaattggaaaatctgcttgcataatcatttttcctcccaataccatacttggctttttacaattttcgcaaaaatttatatagaaccaataagagattagctggcaacaatctagcggttccacgaatcaaaatattacgtaagtattgggagcgtttaacaaagcccctccgcactagtaggttttgaaaatggatttctttctttaagtaatgtagacccccgcgcttgtgtgcaaactcttgattgacatgtgcttttactaacgtatcaactaggttggtgaccggatatttcgcgtgaataacacgtaaccataaatagtaatcttcaaaaagcggcacatccacatagccaccaacttcatcaataacttgattttttgaatgtaactgacatgtgattgaagggattacgaacaacactctgtttgacaatgtgttgatagtcaaccggaacttgtttgacatcaaaaggatgctgttcatcttgatcaaactcataaatctgagtccctacaatggccgtatcaggatgttcgtggaaccattcaatggtctttgtcattctttgtggcatgttcaaatcatccgaatcaaaacgcgccactaattcgtttgtacatgcttttaatcccttgttaagcgaacgtccaagcccgatgttttccggattttttaactcaacaaaccgaatattggcacgttcaaacaattgatgttcatcatgaatcactgactcaagtgcctctgtcagattcccatctttcaccaatacaaattcagttggggataatcttgattcaagaccgaatttaaagcccgtttcaacaattgcggcttttcattgacataaactgacatgagtcccgcatattgataatcggtcgcattggcactcatcgtgcaccgtccccagtaaacacaatcttaacggtacccaacaacattttaatatcaaaccagaccgaaaaatgttcaatataatagttatctaacttgcattttgcatccggtgtaatatcatagccaccgttaatctgagcatatccagtaatcccaggaatgattcgtaagcgctttggaaattccacaaattgttggctaaattcttctgttaatacgggacgttctggccgtggccctaccagactcatatctcctcttaaaacattccaaaattgtggtaattcgtctattcgtgttttccgcataaggcggcccaccggcgtaatccggggatcatttttctgagcccaaacagcaccggtccgtgcttctgcattctgatacatcgaccggagcttaataacgttaaaactcttacccattagaccgacccgctcttgtttataaaatgcgggacctttggacgttagcttgaccaagattgcaaatactaagacgattggtgaactcaacacggtaccaatcaagccaacaattaaatcaaaaattcgcttcacaactaatttccaaccagtaacaggccgaccaatcatcgttaagaactgataatccgtttgtggttgtacatgaccaactttaactgtttcattaatttcgacttgcttcacgttgttgcgccccttcccaatatttgctcaagctcgcttctaacgaccacttcgtcgtgtatcccaacttaattaacttaccgatattggccaccgaacgttttacttccccttcacgccctggcgcctttttaatctgcaatgacgttcctgcaaccttctcatatgtttcaataatggcatttaagctggcttcattaccattggcgatattaaagacttcatgctcagtatcacttttcgttatcaaccataatgcttggataacatcttcaacatacacaaaatctcgcgtctgaactcccgtctccgtacaaggtaaatggcttcttgttattgagacaatcggtcaagatcgacagcacccctgaatatggcgaactgggattttgaccagggccataaacattgaagaaacgcacacagacagttggtaaatcataaagttcaccatatgctagtacaaaacgttccgtagcatacttatcaatcgcatatggtgataatggatcaactcgtgagtcttctttcttaggcaattctggaagattaccataaaccgctgccgaagacgtaaataggaactgtttaattggtaaattagtcttccgaatatattccaacatattgaatactgcagtttgattcacttaatgggtttcagctggacgttcaatcgaatcggcaacactagcaacagctgctaaaaagtaaatataatcaggctgttcttcccgcagcaattgttgcatgaatttttcgttgcgaacatcttcaacataaacggtaactttatcctctgatgcttaatattatgtaggtccccatggacaagttatcaaccacaactacatccaatccttctgcaaccaagtggtccacaaggtgggaaccaataaatccctgctcctccagttaccaatgctttcatttaactcgctccttcttttaaaacaaccagtgctttcgctgttttctgggcatcccaatctcaccagtatcgatctgttcaccattcaacaaatcccgagcgttggttgcaaaacgttcaggatatttcgaatccatttcatttaagacttgataggccttggtcatagcaaagccccgatttttcagcgtatgcgcatctgatgcgaccacttgaactaaaccacacttaacgaattcttttgcggttcgctggacttgttccccaaaagtaccaactaaactcgtcgccgtaacctgtgccaagaccccatcctcagccaacttgtataatcgttgcggttcggcaattatttgagcattacgttcaggcgtgtgcaatgaccggggtaatcccctcacaagacaattgaaaaatcatctcatccaaataacttggtaccatctcgtgaggaagttctaacagtaaatagtgtctactggtatctatacccagtaaatcatcaatattttccatcaactgaccatttagatgtacctcttgaccaggaaaaatggttaacggaatatcatttgcatctagctctgcttgaaataccttaaccgccgctaccacatcaccggcatgattgaggtagtgccgatccatatgatgtggtgtcgctaaaatatagcgaatcccgtcagccaccgcctgccgtgccaattccaatgacgcttctaaggaaggtgaaccatcatcaatggctggtaagatgtggcaatgtaagtcaactaaattatttatcttcatcactgtaatacccgtagccactgttatagccgtagtatccgtgatgagagccatcacgaacatcgttcaacactgtaccccaaaatgttagcttgtgatttctttaatgaattaacagcatcacgaaccgctgctttttgggctacaccttggcgaacaactaagaccgtgccatcaactttattagcaagcaattgtgagtcagtcaccggcaaaattggtggtgcgtcaacgatcaccaaatctaatttacgtgttgccgaagttaaaaactcggtcattttgttactacccaacagttcggccgggttaggtggcttcgggccactcgtcatcacaaatagattgccaataacgggatgaattgcatcattcacatcgtccatctgattggctaaccatgaacttaatcccttatggtttttaaggccaaatgtcttatggattgttggccggcgtaaatcggcatcaactaataggacccgcatcccttctttagcatattcaacagctaaattcccgctcaccgttgatttaccttctcctagcattgcggaagttaccatcaaagttcgtagccttatggtcagtagccgcaaaattgatattagttcgaattgttttaatctgctcagtaatgaccgacataggttcattaatcgtcgtgagattaattggggccgtagtcgttatattctgttctttacgtttaaacatctaacaccctcctaaactcgtttcatcgcttgtgacgatgttcgatcattatgcgtatgatagccaccattcagattcaaggcctgtttcttcattgaatggtgatgctgatggttaaccaagcctaaactagtcaatcctaattcatcagttaagaaatcagcgtcgtgaacgcggcgatcagtgagcatccgaatcgctgcataaacaaatcctaatagtaagccgacaactagcccaatcaacatattcagcggcttcttcggcgatactgcgccatttggcgtttcggccggagcaacaatcgtgacgttgttaactttaataatcttttgtacttgattcttaaaactacgagcagatttgattagcaatcgtcgcactagctttcgcattagcatcagtcactgcaatcgagaaaacctgtgagttagtcgtgcttgtcacactaacttcacttttcaatgtgttcagtgagcgctcaataccataacgtttacttaattgttgcttagctggttttaaaaccacctgtccagcaattaattctttgtaggtcgtaatcatctgaacgtcagcccgctgcccagcgtactcagtagcggcattagtattcttacggttaaccaaaatctgaacactcgattggtacttaggcgtaattacaaagaaggtcaaccccgcggcaactatcaatcccaccaccgtaaaactgacaattgcacgccagtacttacggacaagccgaataaaaagtcaaaacttactgcttgatccatcattcactctccaaaattaactagattaaaaccacattttatgtaacgtcattaaaataaaaagaaagattccttttgcatcaatgattcaaacctatttccataaaatttgtataaacttgtatatgctgcactgaaaacaactattttcatacaataaaatgacatattacattgacaaatattgatgtgatgttatatttgattacagattgtgttgaaacggcattatttttttaaaatagtgccgtttattcgtgtaatcgggtgttgtactagatgtttgattatatttattaattaatatagtttataattgatgattaatagtcataattagtacgtcccacgaaagagtgtgattaatatttactacaatgttgagcccttacgttccaaagaagaaatcactgacttcgttaataaggcttggaacggtacgcacggtgagcgtaacgcgttgttaattctaattggtttaaatactggacttcgaatgagcgatattcttaacttaaaggtcggacagattcgctatcacgatattgtccacattactgaaaaaaagaccaaaaaggaggctgtgacataagtctctagaaacaaaacaggtctggaaaaatcttcggatttttccagacctgtttttgatataatagaaaataaaaaagagcatcggtcgcacccgatactctacgaaattatcctcgaaaggacattcctaatatgcaagattattataacatgaatcaaaccactttgagtatcgccttggattaccaaccagaagagcatcatcccgctcgttacatcaaccaacttgttgagagtttaaaactaaaatatgattaccagtttggccgtccgcgggaatataacctcggtgccatgttaaaactggtccttttagcatactgctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgatctgttaggcgagcttcatgaagctaaaattgtcggtgaaattccggcgggatcagagctgactcccgaactattggatatcatgattagcaaggttgaggatcacttagtggtccttaatgaaaccgtggaagcaactaagcggtgtttccccgaacccagccaaacagcaacgccggactgttaaatcacaaaaacgtaagttggataaacgacgtgataaaatgcgtgaacaccaagcacagcaagcaatctatggtcagcgtaacagctactctaagacggatcacgatgccacctttatgcgggtcaaggaagatccgatgcaaaacggtcaattaaaacccgcctacaacgttccaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacagggagagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaattggtcacggtagggaccaactttaaaaatcaaaggcgtaagcaaatgggacgagaaaccaaaattcggtttctcgtcccatttgcttatacagaggctagttatgtcacagcctctacgtccacaaatcaatcactatattaaagatttaccagataatgaatatctttttaccaatcgacaacatcagccactaagtgttaatgccgtttataaacttttccaaaccatcgcccgtaaaatgcaccgaacggatattggtacccatacgctccgtaaaacttttggctaccattattatcagcaaacccacgatattggaagcctttgatgatgattttcaatcattctagtgaagcaattacaaaacggtatattgggctcaatcaagatgttattttaaaacaaatggcgggcttctcattagggattgatactcaaaataaagccacctcctctaatcaaaagacaggttaaactattacgcttagtttaacctgtcttttttataatgatatcagacaaatccattatttattgattgttacgagcataggtcatctcaactttatttttatccatctgccaccaatcttggtgatccatataccaattaatggtctcccgcaacccagattgaaaatcagtgtataacggttgccatcccaattcatcacgaatctttgatgcatcaattgcataacgtaaatcgtgaccaggacggtctttaacaatatcatatgcattttggggttgcttcattaactttagaatcatttctaaaacagctttattactcatttcaccatccgcaccaactaaatacgtttcaccaattctacccctcgttaaaatgtcccagatagccgcagaatgatcgttcacatgaatccaatcacgtacattgttaccactaccatataattttggccgtcgcccactcaggatattagtaatctgacgcggaataaatttctcaatatgttgatatggaccataattatttgaacaattcgagattgtcgcctcgcaagccaaatgaccgaatccaggctctaactaacatatcactacttgccttagaggcagagtacggactagacggccgatactgactatctggagtaaacttttcattatccatatctaggggtaaatcgccataaacttcatcagttgaaacatgatgaaatcgtttattatacttagttgccgcctgaattagcgtatatgtgccaacaatattagtctgcataaatgaccacggattaactagtgaattatcattatgactttcggccgcaaaatgaataattgcatccgacttgatgcactagcttattaaccaacgggacatcacaaatatctccgacaaccagttcaacatgctttcctaatatatcaacaagatttctaaagtttctgcataagttaacttgtctaaaatcacaattctaatttctggatgtagctcagctacataatgagcaaaattagaaccgataaaacccgcaccacctgttataagtatacatttcatactttaaaatcctccataatattttagctgttgtagcaaaaaacattctcaccataacatagtaagaatgcctttattaaaatgcatatttcaaaaacctcggaaatttttttttttcaaatgaatttaaaatcaaaaatagaataaatgtaccagccactgtcaataacgccaaaaaatattgattgatatttaaattaagcttcatacaaaaaaactttatactaaaaataaaaataaattgtgaaaggtatgtcactgtacttgctttcctacatattttagccaaacgacaatttcacttgaaacttcaggcataaaactaccaaaaagaatgataatggaaacagcataaaatactgatccgtagtacccgctgcatatggtaaattgtaatgaattgccacgtttgcctcgacaatcgaacaaattaacgcaagaactgtgatacttatcaaaacaggctttgaaacatgtaccatccagaaatgacggtgatcaaaaagcaccattcccaatgaaaaaaagaacagtcccgcaaacaaactatttgctggcgaaaataatgctcgtagctgggctatgggtcccatttttcttatcaatgaaccatacgtgctggaaaatacgcttattaagaaaaacggaagtgtataaaataacaaactaagactgctgtgcttaaagtacaatcgcccgagtatagccgcagaaaacatcgacgtagtcaagtaccaacttataccataaccagggactgcattatatacacaagacagaacaaactagtaatgaagttttccagataccaaaggtagatgaacgaaaataattcacactattatatagtataaacggactgttcagtatcatccaaaataaataaagtcggaagattcgagcaacatattgaataatcaacctattcctgtccccttcatcatttttgcttaacttatttgtataaaaataagccgaaacaatcaaaaaaacggaacagcaaatcgtccaatcacattaccaagttgctctccaataccatctggcagagtatgaataaatactacgaatacactaccaatgtactttgataaatctattaaatcatactgttttgaatttcgaattgttttcacaatcatttcctcccaaagactgaaacatactataaagtatcaataatacagtctagagctttcattatggtaattctaataacttattgaatgcatagtattttcctgctgtaaaatcatactggactaattgatattcacggagcaattttccttttgtgttttcgatagtttatcatcagtaattaagttcagcttttttttatcaattaaattcatgctaccgttcggcaaattaggatctgaggtcttcgaggaaaccttggaagcaataactggaagttcggaattaactttgtgtagcaacgcaaaatatggggttatctttgttttctcgtcatcaaataatgcacttgcaaagccatatgtgcccattacctggttgttttctttgttcaactgtttatgattggaccaaatgaagtatggcgtctcatgtgcttggacactatatttttgaaaattcaaatgatcgtatattcctggtaggtgatctccataaaacacaacagaaacattctgcttcaattttgatagcctctcaagaagatattggttagcttcgtccgtgtattttaatccttgtgcgtatgtttcaacttgacttttctcatttttagagaggtggcttgtcaccttaaaatcattatttattataataatccttattatatggcatgtgattttgcattgtcgaaatttgataaaaactatttttaggagaagttttgagtttgtccaacaaaaacttatacgtggacttatcagacacataagggttcttactaatctttttcgtatagttatttggaataccatgatttaaatagtagaagtcattaaatttcatttttttgaacacttcttcacgcgaatatagcgtacctgaatatggatggattgcgtaactatgatcaaacaaagtatttattgaaaatactttcctttggctcggtactaattgcgtgtacggggtaggtaaagtagcagaaaaatttcccatacttaatccggttaatgcctgatactccatatttgctgttccaccaccataaccatcgctaatcattgacccactattcgtatttttcattaattctcgagtatatggaattggatcagaatttaatttgacgcctggtacattagtcgggatcactaaaactctctgaaaggataaaaatgacagtagtattatttgcgtctctgtgcttattcaactttttagcatattttgtatacttagtaacgactttatccattgttttctttgaataatttatcggcttatccattgaagttacattcaaattgttcacaaaattaatgatgggtccattcgattcaacagcctctgctgaatcataatatattggattatctccaaatatctgtccaactttataagctatcgtaccttgattctggatattaaacaaaccccagaagcaaaaaattggtactacaacacccacacatcgtgccataacaggcatattgaccttaacacttctaaacataaaataactagcaactgacaaaacaatgacaataagaacactaccaaaaagtattactggatttaccatttctaggatttttcccatagatttcaacataagtaggtctgagggtaaaactccctcttttaacttaatgaatacttttcatagttgacaactgaaataatcagaactatgttcaaatatagcgcaacagtaccccagtatgacttagtcactgagagcaataatacaaacagcagcacaagtaccaatattgctaaaacttgaactctacttcgcacgacaaatacgttgtgaaacataactgagaaacttgagttcccagacttaagtaacacaatgtatgagaccaaaattatgattgtactaagaaaccatataatatttttttaactctaatgacattcacaatccttatttaaataaattacttacttagatctgacactttattgaggatatccggttgaataattagtattaagccaatataagtaagtatccccacaactacccgccctaacagactgaataccgaaattttcattgttacatttaaggtgtacacaatcatacacatgcaggatccagaaagtagataactaataatattcttaaaaaaaaatgtcgcatttgaaagtcatgacgtacaacaaacaattggtatgcagttacacaaaattctgatattacagttgcgagcatagctcctttaacaccccaggcaataattaatggaatattgacaattatattcaccaatgcacctaaaactacggaaactgtatattgtgccgttttcttagtcggcaacaaatattgttgcccaatcacattacttaacccaataaataaaatgacgggtgattcaatcatcaacaatgtatttacggatgaaaaatagcgcccgaagaaccacggtgctaaggttgttgaaatagcagctattccaaatcctaacggaattgatataaaaagtacaaaatcaaacgacgtgtataagtattgcttaactttttctaactgctttttggcgtataaattagcgatatgtggcaacataacagtcccaattgctgtcacaactgctaagactagtttaattaatttatctgagtaatcataaaaatcctgatgctgagactgaatcaagcttccataacatggtcttattcagagctagataaacagtcatagcaatctgaggaataaaaagcattatcgatggttttaaatgcttaaacatcgcaaaaaaattaatagttggcttatcaacatttcctaaaagatacggccacagcgtcaaatttcccagcaattgtgagatagacaggaccaaaatatactttcccacatcatgtgatgttctgacaatcagaaaagttgcagcaacagataatactttaataactgcatttcgacttacggtctttttaaaatcttcaagccccatgaaataccatgaaatatcaaatgcgcctgcgataattaagaatgactgataaaagaaataaattttatattgtttttcgaaaaacaaaaacattaaaaaaataaatatgctactgaaattgtgaatatttgtaaaaattcaatttcccaaaatacacgtgagcgctttttaaaatcatcacgaataaatgcaatttcgcgatttccataaatagttatgccaactgtaccgaacaacaaaaagtatgtaataacagaatttgtcgtggcatttatcccaacacctactggatgaagtactcttgaaatatatggtactgttaataggggagtgaaaagtatcaacaaattatagctcatgttgtacagataatttttactagcttcatattttctctcctctaatatatctacataacatataatccttctaacaaactaatgtgactttttccatctgactagttgtttaacaagtagaatactcacacctactaataacactattacgcaaagcacactataataaaaactttttacaatttgtatctgtggggtcatgccggcgctcacgtttgcaagcccagaaatatgtgtcctaatcgttcgatcatttgaactccaataaacaattttattaggagcaaattttttcgaatattctaatgctcggaacctgagtattcgacgtatgaactgttctaacaaaatgatacccatgcaactctcttcccagcgctcgcaactctttcccagctaaattcaatctgccactattttcaataccgtagttagtgatcctatttgaagtattaaataaagtgaaaaaaggcatccctttttcatctaagattaacactgcacgactcagatatgccgcttgctgctgataactccaaacgcctaatctttgctcgtaaactcgagacttattcggaattgaatatccaaattcagtgactaaatatgggttcttaactgtatactttggaaataaactgagtaacgactcaggtcgtccattattattatttttattaagataaggatgaaaactaacaatggaagaacccctatatgccgaactattctttatctgagtaattagactcttactgttttttgatttccctctaaatctccactgacgaaaactgcatgcttatcatatatttttttataatctctgccatcgcgttatcaaaactcagccattcattgatgactttctgactcactgggcttcgaacgccattattggtccagaacgcaccattaggctcattccatgcctcccaaacaatccctttattagagttattctttacaaagtgtgttatatccgtagttaaatattcaattgtctgagtatattgttttccagaataatttccaggagttccgccagtaaaattaacaattggtgtcatcttattactaagtgatttatcgattgcatattgtactaatgacgttttccgtttatattctgatccaaacggtaattgatccacaggaatgcgaacatatttgaatccaacctgatgtgcagcattcaactgttcatcaatatattcttttgagtcagaaatattgatatatattccccacttatcagtaatgcctttttcctgagcatttaatggttgataaatacgatatacaaatattaaagccaacaatcagcaatagaaaactataaaatactatcatgtatttcttacttattcgcttacccactcagatggcaccacctaatgtctagaatttattttatatacagtatttcttttctggtagataatcgtattttcaggtacatcctgtgtaacaactgtaccagcagctaccacaacattatctccaattttaacaccctttaaaattgtcacattagcacctatccagcagttatttccgataataattggggcagacacaaatccttgttctctgaaaagcactccttgttcgtgtaaatgatcgtgatcatatagcttcacattttcaccaaacaaacaatcatcaccaaccacaatctgttccattacattcaatgaacaatcattattaaaaaaacaattatttccaatagttatagatgctttttttcctaatttcacaaaaaaaaaccgcgtcttacagataagtgctttccagaattaatttgttttctgtgtcggacacaaaataagtaaagtttactctgatatatcaattttaaaagtaaattcattttttagcctctttgtttctatacttatagttgtgaataaatttataaacaaaggatggaataaaagtttttaataagctcaccaaaatcataactgtgcctctgataccgacattaaaatatcgctttgaacgacacaacaatttcacaatattaattctagaccgtatactgcgacgtttaaatgaactcggattttcacgaaacttcagcacaggatttaagagatttgccccagtaaatccagcggcatacatccgcatccataaatcatagtcttcaattcgatacacattctcattttctgaataatttcctattctttgaagggccgattttcgaatcaacattgcgggatgggcaaactgattccctctgaataagtccaaaacgcttggatactctggatatttttgcgtaccatatatttggtccttgatcaaaaatcaagatgttgcttccaacaaagctgatgttttgatgggtttgtaaaaaaaagcacctgtttagaaaatctattggcaagactaatatcatcatcatccattctcgcaacgtactctccatttgctagttctatgcacctattcaacgatcgaggtaacccttgattttgggaattacatattactcgaatccttgggtccatttttgcaaattttgctaaaatttgttgtgtttcatctgttgacgcatcatcacaaattataaattcaaaatttgtatatttctgccccaaaatagaattaattgcgtcagtaatcgttttagaaccattaaaggtgctcataataaccgaaatcaattctaaattcctcctgaatatacgttctcaatttcacgaatcattttattaagagtataattttcttgatatactttcacactattttgtgaatattctttaatcaactctgtatgcattctaacagagttgatccactcggcagcactagcaacatcattcaatttatataaaaagccgttgttccgatatagttcattgtgcccaacaacatcagtcagaagaacaggtaacccctgcggcttcagcttctatgactgagaatggaagcacttcgtataatgaagtagacaaaaacagatctgcattttgtaaccaatccacgacgttcttactgaacccaacaaaattgatattggtaagccctaaccgtttcacatattcccgacaatcgttcaataattctccatcaccgacaaaagtaaaagataaatcatctatttttttctaacttattggcaattctaatgaactcaaacggatttttctgttcatcgcaccgtgcaatgttaataacatgtttcacttggcatcgtacgcgtggaactgtttcactcaaaattccatttttataaccaactgtttctctacactagataaacgacactgcactgcatgttccttttcccttgttgagagacatttataacatagttatatttttgaatatacattcgttcaattacaataagaatcttcttcttcaatggactgagattcttttctgaaagatacgcatgtggcgtgtataccagaataagtcttttagtggtcaaaacactaaataagtacacgagcacagctgcaattgtactatgtgcatgaatcacttgtatattgtatttatttactaatctggcaatagttatcaaacttttgagtatcatgattggatttttatacttggaaagtgaatcattccgaatatatgcatctggaacatcagcattatttcttgcacccgaaactaaaaagaacgacctatactcgtctctgtcaagatatttgtgaagatagtccacatgtttcttaactccaccaccataagattcacatacttctaaaacccgtatcataatacacctcaatcttcttcgcttaatttttgcatgacaccatccaacttttgctgtaaatactttttactataaagaccacttatcactttctggatttttaatgagtcagcatattttaaacgttcttcgaaaaaaagaaaccaagagattatgagcttgcttaatatttccagaatcgtacagtgaaccattgatatcttcttgaataatatcttctggccctgttgggcaattagacgaaaaacaaggtatacccgcgccatcgcttcaagaagaatcattggaaatccttcaaatttagaggttaaaaataataaatcagcagttttcacacatttccaaggatttgactgccatcccatccatgtaatttggttatcaatttgataatcacatgcttgctttttaagaagattcatatccgttcccgtgccaataactgttaaatgccacttatattgttttacgctacctaaaatatttatcagttcagaaacgtttttttgcccttcgctctggagccttccaacgtaaataaattcttttacactcctcactttggacctgggaataacttggttgctaggatcaacagggttgtacactaaactgatgttatctttgggaacaccgacccttactaactgccgttcaattccagaactgattgctaaatgataatcacacaaacgaaaaacatttaacataaaaggaaatcgagtttctcctaatgaaaaatggttccaagaaactaagtagaatcttcttctgaatatttttttgcaatccaagcagcaataatttgtatcttactcatagaaattacaacatctggattattctttagaataaaaacaatagtatccccaaaatttgatagggcatttcttttatgatgacagattactttatcagaaataccttctaaccaatcttcatccacagatccgcctggtaaaaataagcgaaaattattgcttgtcgtattgttctttaaaatacgcgtgataacagtttccattccaccttttccagttacaaatggaaacaccatccagaatgttcataagcgcccctcattttatggtaaataattcatatttttcccactgatacctttaatcccatctagatagccatccttcaattgctttaaaagataaccgaagtatgggcgatgatcagccttaactgtcataccaacaagtcggcgcgctataaataataaatttgaaggaattagcatcattcgattcgtactatgtttgtgctccatctgaatcctatttcgaataccataatattctttccacgatggtttaaacttttgttggacagtaacattgttataatgatagactgtcgcctcagaaacatttagaatttttgttaattttcgaactcgtaacgcatattcagcatcatcattccaaatgaaatagtccttttctggcaacccagcacttgcaatcaactttctggagaagagcacaccaacaaaggtaaaaccatcaatattaaaatcatgtttgtacgcttcacttgcaattggaacttctttaacagtggcagtatttataagtttccttcgatgtaccaattgaattgaattgtcaggtgaacgaaccgtaccagtaaaacattgaaccttggaattactttgaattttttttttttatctatgcgttcaaaataatgcttctcaaaaatagcatcgtcgtcagaaagacaaatccaatcggcaccaagctcatatgctttggttaatccaaggtaaaaccccatggatccaccaacattttcttttgttcgcaaataaataaccgtcttattatttgcatattttttcatcatcgttggtgtattatcagttgaatgattatctagcacaatcacatattctggtttaactgtttgacttaggacactctcaatggcatcgcctagaagcgcctcacgattgaacgtaactattacacttgcatatttcatttgtttcctccaatataaatttacggaacaaactttagattttttcccattctgcctagccatgcatctcttgtccccgcaaaatgaacatataatgcatgttttctttttcctttatacatgggtttagttaaaatacgtattgccatgattggaacaaaaatactaaccaaaagttaacaacgaatctatttcggccacgttctctcacggcaacggtcctatttctaatccagtaatactcccgccaatcagcggggtaagtagtttggacatctacccatttcgtgtgatgaacaattactgagttagagacattgataattttcgaatattgcctcacgcgtaatgaatattcaatgtcatcgtaccaaataaagaaatctccatgaggaagcccaatttttttaatcaactttacgttaattacacaaccgcaaaaagtaaatagatcaatgcaaaaatcatgcccgtattctttttcaggaacggcgttatgggaaaaataattccaattagtgatccggtttcgctggtcaagttgaatgcgaccattgggcagtttaagttcgtaccggaaaatgctttaacatcaggattctgttttgctttttgtgaaatattagaaaaatatgcttgctcaaatattgcatcatcatcagacaaactaatccaatcaacatcatactctaatgctagtttgacaccaacgttaaaaccaccagacccaccgatgttttctggcagtctaacatatctgaacactttattatctaacaatccagaatcagctataagttctcgcgtaccatcattagaattgttatcaattaaaataatcttttgtggtttattgtcctggttcaaaacactattaatcgcatctagcaggagcgcttttctattataagtaacaattacagatgcatagttcaaaattaatcctccaaacacttagctattaaaataaaaacattttcatttaggcagaaatttcaagttttttcccattttcccaataatagcgtctcgataagcaattgaattcacgtaaaaagcatgccatctgtaacctatataaaatggtttgctaaatactcgaatcatcattattggcagaaacaagagtagccaaatcataacacttagcctattttttccacgtttattcaccgtcaccactctattacgtataccatagtattcacgccaatctggtctatatccagaatctgcgcctccccaatgggtatgatgtaccaatatagaatcagaaacattcataatttcggtacattcgcgtattcgcaaagaatattcaatatcatcataccaaatgaaataattatgatatggcaacccaatctttttgattgtactagcgttaattacacaaccacaaaaagtaaataggtcgatattaaaatcatggtcatactcatccctggagactggctttgccttgagatggttccaatttgtaatccgattccgctgatctacttgaattcgtccatcaggcaacttgattgtgccagagaacgcttttatattcggatattttactatggcaacttgaatttgattaaagtagtcagtgtggaatactgcatcatcatcggataaactaatccaatctacatcatactcaagtgcaatcttcactccaatattaaacccaccagaacccccaacattttcaggcaatctcacgtaccgtattaagtcattattcatcaagccgcttgacgtacaacttcctccgtcccatctgttgaatgattatctacaataactatttttttcggcgcgattgtttgcttcaaaagtgcattgactgctgaaaccagcaactcttttcgattataagtaactattacagatgcatatttcaaattttatcctccaacaaatcattttgtgccaatacattaaatatgcgcaccattgataagaaaacaacaatatacaatggatgcatccagtcaaaagacataagaatcgtaaacacagtaaacccaacaaaaacctcaaataccatacatacatccaacctatagtgttgtccctaatagactccaaccaggtacccgtaattttaagaattctatagattccgtaagtaactgttccgaaaaagattattccaaattgcgcaagccaccctgttacgacagataatactgcaaaaatccatctccacttagaggccagtagctattaaactcaggattatatctcatgaaatttggcgctaaaatatagctccaatgtccaccattgttatagccgacacccaatccaaaactctttacaaagattttcatcattgtcacagcagaacccatccgttgagcaaaacttgtattggagaaagtaaacttgtcgaatacaactcttgttatagtactagagaaactcttactaaaaatcatagatataattaatacaagtattgtccctcccactactgcaaacacttttttccaacttttaacaacaataataatggttaaaaacaagacaatcggtaacccgagcatagcagtagtagatccactcatgaaacaaaataataattattaaaataagcggtatccatatcttatattcaatctttttttctttcacatgaataggacctttttaatctagtcagcaaatatggaatgaacacaatcagtaactgtgcagctaaaaatccagtctcctgctttaaaccgttaattctaccagttgtcaccgcgtacgatccttgtgcataccatgttgaaatcgctgttccaccgcgctcctcaaataaattcgcaacaaaattcacgagttcttttccaatcccgaacttgatgtatataagttgcgctagacaaacaatcaaaagaatccacattgcaatttcaattccatcaaaaaaacgttgtatgtcatcatgagattgaatcataaacgtaatgattacataaaataaaacgtatactgcaattagcattatagaattcttcatagaggaagatattgatgatcctgaatattgaggttgtacaatcttagaaacaaacactgtaataatctgagtgaccaataacagtattgaaaacaggcaaatatatttaaattctgtcatcgataatcggacatttcttttattgaatagcatcccaatacacaatatcaacaatgaaatagtggcgtatgactccaaaggcatataaccatgtggaattgttttcctaataatgataacggtaataaaaactgcgccatgactatttctccttaaccgtatcttgacctaatgatttaagaactaggttctcaaacgatgttgcaggtgaataattccccataataacataaccgctatcaccctttgagttgaagctagaaaccatgtattgatgatcagcattgtaatttatattaatttcaccttgattgctctcaaaaatatcccgaatattattaagctgatgatctgttaatccaaaatgaccatttaacaatgcggtcataaaagttgcaaatgaaagtggcgtggcaaccactgtattttgctctactttttgacttttgaattatactgaattgttttccgatctgtttcataaagctgtgcaatattcatactatttttataggtcgcatatgtcccaaatgatgctaaaccaatctttttgttgatattttcagaaataacattctgataacgttttgaactaattgaaccgatgatttctctacaatactggttgtattttgaaactttcattaagtcggtcttacccgaaataatgaaggttccatttttatatacgttcttagcctgttttaaaaataaatttaatgtagctttcctatatttatcgttaatattaaatgcactaatcttttcattggtatttaattcattgttttccactagcctatcaatcagtaccagattgacaagtaatgttagattatcattgggatacattgtattgatggtatttggaatcctgtaggcgaaatcttgattagcatatggttttgaaactcaaccgttttcttatcaaaaaacacaatactgtgcccgaaaaattatgtgcttttaactggtcatctaagaacttactcttagtgtcaaatccatattcggaaattaacccattattagaaaaagctttatctgcaattgcttcagtacttttagcattaataactgtctttttattaaccacatatccaagtccaatacaaagtacacctaacaaaacaactattataatcaggtgtccaaataacttacccttcttcatacagtgcacactccgtctaatcaatccaaatgtaacccaaaatcttctttccctgtgaccgcataacattgaccactcgttcaatctgtatccagcgcgtatctgattgtgaaacaactaacacaacttgatctgccagtaacaacatttcacttaacacctcatctgttaggctcagtgtattaataggcagaatattatgttcaatagatccgctagacgttctgatattgttctcaatcctgataagatctaccagattatcgcattatccatcaactgaatcggctgaatcgttaaattattaatttgagtttcaattgcttcctttttcgttctatctgttgatatggcgacttgttttactagattcgattctcgttcgtccacatagacacacgtgttctcattatcatttgcataagcaatgccaaggttaagactgacactacccgccctttttttttttcggaacagtctacacaaaccaacacactattattttcttgggtggcagttattctgtttttaatcagatgaaaatcattaaacaatttgagctttgagtcttttacaatatttacgttcttagtcactatctattccacctcacatatatcatcgctttttcagcttaacactgccaagactgtctaattgaagccgaatacgtaatgccatttcgctcttaactgtctgagagaaaaagtcatgctttacagatactaaaattgcaatcaccattcccaaaatgaaccccgccaaggccttcgcttttcatgttaggataaacaaaattagcatttaactttggtttgctgtaaataagcaacggcaatcctggtacatagtttcccgaaacttttaataggttattcagtaccaattggttgaccttgacagccagccttggattagttgatgttgtgttaattacaacattttgtgtgccagtctccacgcttgctccaactattgatgcaacttcatctgcatctgaactaaactcagagctgtttttaagttggtctgtcactaattctataactggtcttccagatacaagcttctgaattgataaagtttgtgtcgacgtataatttgcactagcaattgataccttcgaggtaaccatgtatttttgggaataaataagtaggctaagccaccaataatgagtgaaaaaaccaatccaactattatccactttaacaacttcgataatgtataacgtaaaacatcaaaaatcgtcacttacttttctcatcagcttaaaaatcttctttaatttccttgcttacagtcactaacgcagcatgaataacttgatgcatatcatagtatcgatactgccctaagcgcccaccaaaaatcacgttgccttcttgctttgcaagttcagcatattgtttgtacaacgtgttgttacgagtattgtttacagggtagtaaggttcatccccacgtttccaattagccggatattcacgggtaataactgttttgtttttgtcacccttaccgaattcaaaatgtttgtgttcaatgattcgtgtataaggtgtttccgcatccgtataattaataacagcatttccttgatagttgtcaacgtctcgttcttcggtctcaaatcgtaacgaacggtattccaattctcccaattgataattgaagtattgatcaatcattccagtaaatataatctttggaaaatcggctgaatactggtccttgttagcgaagaaatccacaccggtctcaacacatctcgatttcaggatgatctaacatcttttcaacaatttgggtataaccgccaattggaattccttgataagtatcattaaagtaattattatcgtatgtgtaacgaactggtaaccgccgaataataaatgctggcagatcagtcgctttttgtccccattgtttttctgtatagcccttaattagcttttcataaatatcggtaccaatcagtgaaatggcttgttcttcaagattcctaggttcaccgcttaattgtgcagcatctttttgttcctgaatctttgcttgcgcttctgcggtgtgcgaactccccagagctcactaaaagtattcatattgaaaggcaagttatacatatgacctttatagtttgcaaccggactattcgtgtaacgattaaattcagcaaattgattaacatactcccagatttgcttatctgaagtatggaaaatatgcgcaccatattggtgtacttgaattccatcgacctctttcgtataaatgttaccagcgatatggttccgtttttcaatcaccttaacacgattaccgcgtaaagctgcctcatgggcaaaaacagcaccaaacagtccggcaccaacaaccaaataatcatacttactcaatttaatttcctccaagaatataaagtctcatcatgtcattatggtagattgtaaaattaatccgaacgctgttcggacaaaaagatcagcttcctttaaaatggtgtttaccacaaacccattttttaggagctgatcttttgtctagtataacctattctgaacgaattaaaattgaaaccttttgtgagctaggactgaccaatatccaaatggctgagcggttaaaacgatctccgtctacgatttcttatgaattatctcgttgtcaaccttatcaagctgaattagcacaggccaacgctgaatataaacgggcgcattgtagccgaaaaactaaactgaatgccaaattaaagcaaaccaaaaattctaaaccatttacgtctaagctggtcaccagaagtgattgcgcatgagcttaaactagccactaaatctatttataattggctatatcaggggaaaattgaattctccttaagtgaattacctgaacatgggctacgccaacggcgtaaccttgaccaacgttctaaatataatcaatcattagggcgttcaattgaacaacgaccaattgtgattaaccaacgtaaccgcatcggtgattttgaaatagatacagtggttggccctcgtggacatagcaaggctgctttattaacgctaattgatcgcaaatcacgttttctttgggcttaccgattaaaagatcggacagcggcgactgttaatgaagccctaactaagtttctagcaacttttaagggaccagtacacagctttactgttgatcatggcactgagtttagcaagttagtattatttgaaccacaatacggtattccgacctattactgccatgcttacacgcccgctgaacgcggcagtaatgaacggttcaatcggagcttacgttatttttaccctaaggggacttattttgagcacattagtgctcaagatttaacaacgacgttactcgaaattaaccagcgtccccttaaagtacttacctggcaaacaccttaccaagtgatgctgactaatttgtcaaaaattcggattaaatttgcaatctaccttatatcaaaaaaattttaatgtaaaagggcaatcgttatattgttgtataaacatcgataaaaaaagacgactatttttacaatagccgtccaaaataattatagtattatctacccaatcccaaagaacccatgcataaacaacgccgcacaagcagccccaacgaaaggtgcaatcccaggaacaataatcccgtattgccagtcgctatcagccttgttcttaattggtaagatggcgtgggcgatccgtgggcccatgtcccgtgcaaggttcatggcgaatccggttgggccacctagccccatcccaatggcccagactaagagcccaacaccaatcggcacgatccccggcgtcttcacttcagaaatagctaaaatcccagaaataaaaataaatgtatcgaagaattcgacgaagaagttccgtggtaagttccgcacagcgggtgcggttgagaataagttccgaatcgtaattggggaaatctcatcagcagaagcggcaaaatggtccgcgtacatgatccagacgatcacggcaccaacgaccccacccaaaacttctgcaactgaatacgggataaacaatgaccatgaaaggttccctaaaatacattgggctaataccatggccgggttaatgcagacattgccgaaaatgaagagggcaattgtaatcccaaaaccccatgttgtaattgcgaagatatggccggaaccgcgatacttggtcccctttaaaacctcactacaatgtacaccgacaccaaaaaaataatcatcaaggcggttcccatgaactctgccaaaagctgatgaatcactatctttctcctcctgtggcgttgttacgcctgtttattttgaaatagacgccacttactttcagaaagcaccggcacttttttcacacgaacaccattatacacaaaatccgaatcgtttaatatgtaaatcgcaaaaagttttgattttacaggattaaacgtccggattcaattaaaaggttctgattattctttttagtcgtttttttgcgtttgaagaattgtcgccgaatgcggcgaatcatccgtggagactttggctcaatcgtatgctcaaaccattccgcaccgacgcattgacgacgccaccaaacatcaagagaatcccggaaaaattcaaccagaacatcagtacaattaaactcccaatcgtttggtaagtcgtaatccgtttagcaaataattcgatgtatacccggaacccttgcgagatcacaatccagtcccaatcgtcgtgactaacgcccccgtccaaatgtaacgcaatttcaccttggcgttcggtacaaagtaatacaacaacatggcgacgacgaacatcccaacaaaggtaatcaagtttttgttttccaacaactgattaatccaattcggaatgattgcacgcgtgaggttcgttaaattcaagatcacatctagaatcaactgactcaacgtgaagaaaatcgccagccctacgattaggagtaatagtcccaacgttaagaaaaaggcaataattcgcgtccaaacggcattttgggcatctgtaaccccgtacgcctcatttagactcccgcgaatcgcagcaataattttagacgccgaccagactgtcaccaaaatcccaattgacaaactactactgctgccactagacaggaatgaaactaaaatcggcttaaacgtctggtagacgttactaggaatgacttcctgagcgtacgctaaaatctgcccagacttcaaatcgaaccgggcaatgaggtttccggcaatcaagataatcggggcaatcgacattaacgcgtagtaggctagcacaatcgcattattgctgacattggcttgtccataccgccgaataataatttccaggcttttcgcaattttagggtaacgggcttttaaattcattcatttatcctcaacgctcacttatagtatttacaattatacaatggaatgccgcgggaaacaccttttatactaggattagtgctttcggcgaatagactagtcggtccaatcagatcaattgatggcaatacctgaccactgatgagtaaaatccgcttatctcccagccgtcagccactttgacaaaatcaagtagctgcctagacgctcagtagtaccgggcccatccaaattttaacgcaaaaaaataaccggtattgatacccccgcggcatccatatccggctctttcacatctttacggaagaaatgaaaatttttatctatactatgtcagtgcttaatattacactgtttatacaaaaatgtaaataaattaatgtgtaccaatttttttcataatcgcttgtaagatgtattccgcagcatgaccatcgccataaggatttttagcgcccgccatccgttggtacgctgcggaatcatctaacagactggtcattgctgccgcaacccgctgaccatcagtgccgactaatcgtaacgtccccgcggtgaccccttccggtcgttcagtagtatcacgcaatacgagcaccggtttattcagtgacggggcttcttcccgcaccccacccgagtccgtcataatgaagtaactgcgcgccgccatgttgtggaaatcaagcacgtcgagcgggtcaatgaggtgaatgcgatcggtatggccgaggatacgtttggcgaccgtctgcactgccggactcaagtgtactgggtagaccacttcgacatcgggatgctgagcaaccactcgtttgatggcgagtaaagaccgcttccatcggggcgccctgattctcacgccgatgcatcgtgagtaagatcatccggtgcccgggctgaatcaaatcaagcgcagcgtgttgatagtccatcgaaaccgtctgttttaaggcatcgatggccgtattgcccgttaccgtgatggccgcatccggatggttttccttcaatagattctgccgacttaattcggtcggtgcaaagtacatgtcggccagcacgtcggtcagctgccgattcatctcttcaggatatggcgagtacttctgccatgtccgcaaccccgcttccacgtgtccgactgggatttgatgataaaaggcactcacactagctgcaaacgtcgtggttgtatcgccatgcaccagcacgatatcaggcttgactgtatccataattgcatctagcttcgtcagtacccggctggtgataccagctaacgtctgattaggcttcatgatattcaaatcatagtccggcgtaatgtgaaaaatcgtgagcacctggtctaacatctcgcggtgttgagccgtcaccaccgttaccggttcaaattgtggctgttgctgcaactgcaacacgatgggcgccatcttaattgcttctggccgcgtgccgaaaatcgtcattaccttaattggttttgtcattaactttcaccgcatcatttagtttctaatctcatcatagcgttagttacgtcgtggcgccatcatttcaagtaaaagtttagttattttcaaggattcagccaaacagacgggtaagcaaaaacaccaccttgattgcgggcacacattctcccgcaattaagatgatgttcagcccgtaccgtttctaaaaaggtaccgtcttcaataaaatatcacgaatcttatacgctacctggttgtcaccaccaaaaacaccctgattttcaaataagactaaggcgactttggcatttcgcgaccccatatagtagctatgaaagttattgtcattgccacccactcgaatcaactggccgcctggtaataaacgcccgccgaatatttaatttgaaaattatccgcaagtgactttaaaccagcttcgccaactagttggccgctttgaagcccatacataaatttataataatcccccacactcatatatagactaccacagcctaattcactagattgtagcggcttagaaatgatgccactctgaccaaacccattagccaagcgatacgaagtcgggttgatcacattgcccggaatatcgttatattcataggtatgttttaatcccaatggccgaatgatgtcattagtcaaagccgcctgataggatttatgcgtcactttgcgaataaccccgccaataaggtaaagttcgcgttggaataggcataagcatgattattcgtcgaccgtaaatgttgcagtgtaaagttcagccgcgccgtctccgttggtaaaatcgtctttggtgttatctcagtcatccgaataccggaacgatggtctaatagttcacgtatcgtaatctggttggcgtacggaatttccgggtaaaagtgactcagcttcgttgtcagactcagcttaccttgattgatcagtttttgaatcatcacgccagtcacagctttttgtaatgacgctaatggataagcctccgtcgcagtattgcggacttgattggcatcatccgcataaccatacgttcgaacccggacccccgccggaccgttcgtggtcagtaatagtgtccccataatatgatgacttttgatcaactgatcgatttgcttgattgcctgggcctcagtaagctggccgggcttcactttaggcttagtcgtcgtttgctttttcgtcgcggatttgatttttgacgctgcctgctgtactttaattgtctttggtgtcacttgctgtgctccttgacctaattgctgtgatccccacacacccacgccaatcaaccccagtaagattggcaataaacttaataaccaacgccgtttgttcatcatgatccccctgttcctgatgagtcgcccgtcaaatctgacttgactactatttaattgccccaagcatacgccctcacttctgactttgcattaaaatgcgaattattgttagtccgccgaaccaaatcgcaatcgctatcaacagcacggttttaccacaatcactaaaaattcatcaaaatttagttaatttaactcgtgcaatttccgaacgtgaccattaaaatgaagattatagttaacttattcaaggaaggatgatcatattgagtcaagcaaccgattatgtccaacatgtttaccaagtcattgaacaccgtgatccgaaccaaaccgaatttttagaggccatcaacgacgtcttcaaaacgatcacgccagtcctcgaacaacatccagaatatatcgaagccaatattttggaacgtttgaccgaaccagaacggattattcaattccgggttcctttggggctcgacgatgctggtcatgcacgagtcaaccgtgggttccgagtacaatttaactcagcaatcggtccttacaagggcggcttacggttacacccatccgttaatctgagtatcgtcaaattcttgggctttgaacagatcttcaaaaatgccctgaccggcccgccaatcggcggtggtaaagggggctctgatttcgaccctaagggcaaatcagacaacgaaattatgcgcttctgtcagagtttcatgaccgaactgagcaagtacattggtctcgataccgacgttcccgctggtgatatcggtgttggtggccgcgaaatcggcttttatacggccaatacaagcgactccggggcgctgaccgcggcgtactcaccggtaaaggattgaactatggcggttcgttagcccggactgaagctaccggttatggtctcgcctactataccaacgaaatgctcaaggccaaccagctttccttccctggtcaaacgcgttgccatctctggcgctggtaatgtcgccatctacgcgattcaaaaagttgaagaactcggcggcaaggtgattacctgctccgactcaaacggttacgttattgacgaaaacggtatcgacttcaagatcgttaagcagatcaaagaagttgaacgcggtcgcatcaaggactacgccgaccgtgtggccagtgccagctattacgaaggttccgtctgggatgcccaagtagcctatgatatcgcactaccttgcgcgacccaaaacgaaatcagcggtgatcaagctaaaaacttgattgccaatggtgccaaggtcgttgccgaaggagctaacatgccaagcagtccagaagccattgcggcataccaagctgccagcttgctatatggtccggccaaagctgccaatgctggtggcgttgccgtttccgcccttgaaatgagccaaaatagtatgcgtttgagctggacttttgaagaagtcgataatacgcctcaagcaaatcatgcaagatatctttgcacactccgttgccgctgccgacgaataccacgttagcggtgattacctgagtggtgctaacattgctggcttcacaaaagttgctgacgccatgttagcgcaaggcttagtttaagccaactacatttaatcgcatcaaaaaaacggattgtcattatcgacagtccgtttttcattattattaatcataaaatcaagttaaaccttatcagccggataacccgtgtgcgcaaccagttgcgcgtaggtttcatgtaacgtcacggccgcgacccgccagccgaccttcaaaagcggaatcaaccgcagtgggtcttctaccggcacttgatgttcatgggcgaacttacaaatcgccggtaaaacttccatatcagaattagcaaaataataattaccgctatcagtcagcacaaagatcgtcgcccgaaatgcgtggcgtgggtcgagtccttccgttacgtgacacaccgaatcgcaccgatctgaattcgccgcaccgcactcagtggcatttcacccagattgcgtccttctggtgaccacaaaacgacctttgtcggggtcagttcgaccattgcgtacttctcgctcgacgtccccgataagcgccgtaaccagttacgttctggttttggctttggatactcctgtccctgaatctcaaaatgaaatggaaccacgcacttttgcgcccgctcaatggcccgataatgacccgcaatttgatggttcgtaaaaacagatgccattggtttaaacataacactcacccctctcaccgtcagtatacgctttcatgtgacaatttacagtgatttcatcacgacagttttcatttttgtcgcagtgttcggctgaaaataagataaaaatagcggccaaattacagcgtaacttggccaccacgatacttaccagcttggctcaaactatgtgtcaatattcactgcccctatgtgtgctaaaccgacttgcggtcacccccgctttgaaccattccgataagcctggatcaaagtaataattgctgaagtcaccaatcagaccttctgacctcgtcattgcaaccgcagttgcctagtcaactctgaccatcattattatagcacctttgttaacggttacacaacgctagaactcattccttaagtcatcaaaaaaagcttgccagtttgacaagctcttggattacgcttattcagcatcattgggctggctatcatcaaagtcagctggcatgatggcaaagttgctagcttcagttgacaataatgctgcataggcccggactttggcagacaacgctggaatgatggcaccattcaaattgttcaacatttcttgttcgtcgtcttcaattgatttgttgtcagattgacgttcaataattcccaccatctcaccacttaggcgtacaatcgcaaaaacggtcgcggataagtcgaacatttcttctttataggtcaccttgtaattgagcacgcacaacgtcatcgccaaacgtcttcttaacatctggattggcggtcgtatagctgaattgcccctgaccaggattgtcatcgtcttcagaacgatcataaacgatttggaaatgtaagtcttggattgctgagtttaagatttcaatattcatttagccaaactcccttttatatattactcccaccataaaggaaaacttggcaaaatacaatcaaatttgccggctttttgtgaataatccgttaatatgccgttaacgttttgtaaagtcagtaacggaccttaggttgacgctgactcgaattacttatacactaaataaggattttagttaagggggcgttctatcatgtcgatccaccgaggattaccagtgctcgtcatcctggccgtctgtggcggtttactgaccccgccggcaaccaatgcacaagccttgcgagttcggggaacccgtgtcacaatgcgagtcaagcaccgggcgaagccgtcgaagcaccactactcgaaacggtcagcccgctcacacaacgccaggcatcatcattaatttattgctaatcgtttttgtcgttctattcactgcatgtataactttcttaaccagatcgctcaccagtgttgtcttaacagcagtatcactgccacacaacgtaactaattttgtacccgttgtgcgtttttttgacgaaccttgtcaggcatcgtttcagccagtaagtactgtcgaatcaggctgacgatttgcttattctgtggtagatcggagtgcgccgtattcgcccccgttacagtaatctccgtaaaatgcttgacctgatcttgaaagatgtacttaccgtagttaacgctgttatacggcaccgtcccatcactggtatagttttccgtccccgcaatcgagtaaacggttaacgattccggcaaaccagtccgataacggtaaagttccttgaacatgctcgtcttggcggtcgtacttgtcgattccatattgtacggcgaggcaatcgtcattaaccggtcaatatgaaccttcggactttcctttagatagcgctctaaaaagagggtccaaatgaggccaccattggaatgacctagcgcataaaagtgattaaagtgatacgttttgaccaacgccttgaatgccgtattcaaccagacagcttgcttatcaatattagctttaccatcacgattattcgcgaagccaatcacgatgaacggctcattatcattagcagcaatcgaaccactatacttaattgtcccatccgtctgaactgtcagcttcaatacactgtgtttttcggcgtttccttccccaactcggtaatcaaactatcaaaccggttctgtgacgcactcgatccggggaccataataactggtgccatccgcgtccgaccagtgtttttcagcgtcttgatattcgcttgactccacgtgtaggccggccaacagatcccgactaacaaaaccgattccaagaagccaccgccaccaatatcgtttaagcatccgccttcgcctcctcctcaacctggtttgccaataggacaaatggcaagtagattgctgtggctaccgctatattgatcagactaacgatgaaggcccgccagtcgccaccagttcccagccaaccggtcaagaagcccggcattgttctaccaaccggataaacgaccggcggcatccattgaagcttcaacgcgcaccacgtgatgaccatgctagccagtggcgctaatagaaacggaatcgctaaaatcggactataagcaatcggtaagccgacgagcaacggttggttgatattaaacagtactggcaaggcactggtcttggccaccgttcgataattacggttacgtgaacgccacaaaattgcaatcaataacgctaacgtcattccgggaccacctacgttcgcaaacgcatcaaataacgtatggagcgttactggatttggctgcgccccacgccgaaccgtgttgcaacgcatattccaaattttgaaccgtactcgtagtactgttaccactaaagtcaaccggaccgataatcccaattaaccagtataaattgctgagtgatgccacgccaattatcgctagtagcgacgcccccggattactgaatggtaaggtgaagaccgcgtaaaacaggccgtttaatccccctttactgacaaaactaataccatacccgatggcactgaacaccagcaaagcagcgactatcggtaaccagttcgcgtgtgcccgcgctagcaagtgcgtctgggtctcgatctcctggtggatgtgtggataccgtgtcaaatgactgaacaaccaaccagtcaacaggcccaccaatagtgcgaggaagatgccctgagttcccaaattatcttctaaaaaccgactgccagcgaggctgaccctgggtactaaaaaaattataattgatattaagcatgataaaactaaattgccgccgtcaatcccgctaacaaattatcacgctgagcactccgcgcgacaaaattagcggctgaaaaagccgcaatcacggcaagaatgccgttgatactcagattaagcatcgtcgtgtaagctgccaaatatttaaaacccggcagccagtgactgagataataaatatgattcaaaaaaccattgcgctgaaagattgcctggttcataaaactaacgtacgccccaactaatgcgaatggaaaaagcagcgttaacgtatcacgtaaggcgcgccaataacgttgccgctcaacgacccgttcaaaggtcaataggctgttctgtacatgctttaacatacctaacccccaaaagaaatttactgtctataatatacgctagttcatcgaccccgcccactaggtgcgtttaattttattgcccaacactaatccattataattatcgtaaagataactggaggtggttataatgccaagccgttacacaaatattttagtacccgttgacagttccgatgctgcacaagccgcttttactgaagcggtcaacattgcccagcggcaccaagcaaacctgactgcgctctacgtggtggatgacagcgcctaccacacccccgcactcgacccggttctatctgaattactagacgcggaagccgctcacgcaaaggatgccatgcggcagcgacaacaattcgtcgccaccacgtccgcaccgaatttaaaaactgaaatcagctacgggattccaaaacacaccattgaggactatgccaagcaacatcccgaaattgacttgatcgtgctcggcgccactggtaccaactcgccccatcgcgtagccgttggttcaacgaccagctacgtcgtggatcacgccccttgcaacgtcatcgtcattcgttaatcgcaacgcccgctactagtcatttggactggtagcgggcgtttagactaatacagtattcatttcgatttcatatcatttgtggctacttaaacccaaagcaccgtttcaaggtaacgtcactaaaacgctgccctgaaacggtgctttctaatattcaactgaccccacccggactcgaaccgggatcaaccgcttaggaggcgggtgccctatccagttgtgctatgaggccattaacaatccgtaaaatatcatctcacggattgtgcattttggcaattactgattgctaaagcgatcacgatttttcttgcgcatccctttttcttagaatgcttattgtgacctttcttctttttaggtgttgccgcagcgggccgcttccggctcgtctccactcgcttaacctcatctgggtgaccagcactcacgacccggtgccgaccgttagccgcgttgccagccgtttctggatggtcgaacgttaacggtggaacaactttatctggtttcgtatcaacaatatgataatcgaccaagtaacccggcttgatttcatagtcagtcgtcgcccatcagcttcttaaagtcgcggacatcatggtcgtcaccgaacgtcaagactagtccatcagcacccatgcggcctgtccgaccactccggtgaatataagtcgtgacatctttaggtagctgatagttgatcacagctggcaattcaggcacgtctagaccccgagccgccaaatcagtggtcaacaacagcccgactttgccttgccggaataaccgcaacgctttttcacgttcaacctgacgttgattactggtcaaggcaacgtaactcacgtgctggtgtcgtaattctaaggcgacatgttggagttcccgcatcttattgaagaaaacgagggcccgcatatggtcaacacgactaatccgtttcagtaagtccacccggtgccgattacccacttgcatcgtccggtgccgaaccaccccctgggtctgatcaatggcccgcacatcgattttttcaacatgctgaccaaaccagcgtggcaactcatccgtaaaattttagtttcggttgctgagaagaagcctaattgtaacgtttcagcaaatgtagcgtcgagaatttcacgaatctgatccaaggtttcatctgtcagtaattcatcggcttcgtcgacgatcatcatcttcaaatgcccaagcttgatcttaccatccgcaatcaggttagtaatccgccccggcgtcccaacaattacttcaggatgctttttgagcttttccatctgccgcttaacgttagcccccgtaatcgcgaggactttggcatcgatcaactggccccactcgcgcaccacgttggttgtttgcattgcgagttcttgtgatggcgctaagatcagtgctcgcgtaccttctccgacccgcaacgcttcgagcattggccacgtaaacgctagggtcttaccagaccccgttggtgcgagtcctaacaccgattgaccagctgcaagtggctcggccactgccgtttgaatcggcgacaactcggtgtgaaaccccgccgccgcaaatttagttttaaatacgtctaacatagtgcctcatttctatttatcggtatcaggggcttcacccgtaaaatataggtgccctgactgccgcaaattaaataatagtttattaacatttcgactaagttgccgccaagctaagtattccgtctggtgattgcttgggtcattgataacggttgcgaagtcgcgcgcctcggccagcattggattggtatcgggttgcgccccaatcgcatgctcctgaccatccttatcttgataagtgatttgtccaagttcagcaggattatccatcacaatagcgtcgcgcagaccgttgatttcagatggcaagaacgaattactagtcttaccaacgttcaaggtcaccgtaaagtcagcgtagcgtaaaatagccacacccttaccgtcaacgcccgttcgaatcaaggttgggtagtaagccacctcttccggcatgccgaaccagccgaccgcatcgtaggccaggtacacacctaaatcctgaagcgccccaccggcaaagttcaacgagaagatattcggttcttcaccagccaagacggcgtcataccgtgacgagtacttcatgtaagtcaacgtcgcaccctgaactaaggataactttttaatctgatccttgacgcgttggaaattaacttcgtgaatctggcgtgctgcttcaaataataggacatcagggtgagcctttaaaacggcatctaactgttcaaattcttgttggttcgccacggctggcttctcgacgatgacgtgcttaccataggcgattgcttgtttagcctgggcaaaatgcagactgtttggtgacgcaatgtagaccgtatcaaaactaccccgactgaaaaatgcatctaaatccgtaaaagtctcatcggcatgattcttggcggcaaaagccgcgcggtctcagcatggcgggaataaacactcgtcaattgccattcaccagaggcagcggcagcatcaataaattgttgtgtaatccaattcgttccgataattcctaattttaacatcgatttgactcctctcaacggcgctagtcaaccagtcgtgattggtggcgcttactcgtgcgtttagtttataattctattttaccagttttcgccgttaagttgggccataaggatcaaaagtcacccgctattttgcgcataaaaaaagagccgccacacgggcagcccttttaaaagctaagattattgaggaacaacgttagcagcttgtgggccacgatcgcttgattcttcatcaaaggtaactttttggccttcttctaaggtcttgaaaccgtcagtttggatagctgagaagtgaacgaatacatcgttgccatcttcaccagtaataaagccataacccttatcagcattgaaccattttacagtaccatttttcatgaactaaatcctcctaggatataaaaataaaaagtaactaacacatgttgaaattaacacctataaagaatttacggtaacacaattaaatgatactttaaaacttcacataaatgccaatcacattatatagattaacacactcacccagtaatttccaatcagaacacaaattaattcaaaaaaattagttaccgcccttccgaaattgataaaatattacgttcattacccgcgggtaacagtgacataaaggctttaataagaatccacttattacgtgacgttaacgccgttttagtggtatattttaactatagatttattcagaaagaaggttgatccagtgaagcggcgtggcgcaatattatttggtttatcattacttgcaggactttctagtacactactccacaaacggcaccctagtacgatcgctgacggtgacttagcggttttctacgcgggaacttggacctatcgtgatgaggctcatcaccgggaccacacgttggagattgatcccaacatgatgattcgcatcgacgggcgctcggtaccagccaccgtcgaatccatctcatcgagtgcgctcgtcttacttgatcaatatggatttcaccttgaggtgcgggctaatgagcaacgacctgtaaccctctttgacgaagccgatgatcgcagttatgtcatcttatcgccaaatacctaatgacgctagtgacgtcctaaggattttaataggtcgccatcaaaataagtcgcaagttcaagaagagtcttgaacttgcgacttatttttagtcagcctagcagctaataagctgttaatttaatttgcgaaataagttattcaaggattaggccttaatttaagccccgcgccacaactttattgtacgctgtcacactaccgttgaatagaattccagcgaactcttgacgagtcccgttctggcggtaaacggcgcgatcggaataatgcataaacatcactcgtcgtccctgttggtgggtcttcgccgtgtccagccataagtcagtgtcttttagtgcgggcttaacgatctgcttggcaactgcgggcgttgaccatacgacgcaggagcgattataatcctggttcaacgtggtcactaatgccttaagcttggcacgactttttcgaaccgcaatcgtctggtccgtgtagtcaccgtagtattgcacttgaatcgcaattggtaaattgccgatgctatccccgaccgttttctcgaaataggccgcttgggccgcagcagtcgatgaaaaactaaacgtatggattacgccaacacctaaacttgtgccaacgattcgttcataattgcttgcaaagttatcatccgtataactagctccttgagtagcgtgtaaatagacaaacttgagcccatcattttgcaaggccgcaaaatctaaataaccgtcattttgtgacacagcaaccccacggacatcaaacccactcacgacagcgtcactacgccaacgtaaccaagccaagccgccccaaacgctgcctaaatgattactaatagaactaataaccagcccagtcgataacgccaccgcgcccaccgcgtttttgcgtatactggtcgataatgttgccgctttgtcatctcatcaatcctttgcctacagcattaaagctccgttcgtgtttgactaatggcctcgcgaacccggccaagactttctgccatttcgatattgccatgaacagcagtcatcaagaagagactatcgataatactcatctgggcaatcaacgaagtcagcccttccgaacgatagttaatttcttctgcaactgaaataaaggcaacggtactgtccttagccaggggcgagttaccgaagctagttaaagcgatcactggcacactttgtgaagtcagggtggctagcacttgtagtgtttgctgattacgcccggtatgtgagataaccactgccacgtcactggcattcatctgagccgcttgcatcagttgcatatcatagtcactattatggggcacacggaataccggtgcgcacaaacttatgatacccatctaaggcagcgactgcggagccccgaggccataaaagccaatcgagcgagcatttagcaataattccaccgcccgcttgagatctgcttccgtcattacctgacttgtctgatctagcgaactacgaatactattgaatgttgattccgcaattcctttgaaagtcgtttgtttttcgacatcttgaaaagcttccgcattagtttgttcaatcggttcggccgccgttagttcacgtgagaagtcacggaagctactaaaactaatccgtttgacaaaccgtgaaaccgtggccgttgaaacgccaaccgcggcagccaagtctgaaatcgactgagccgccgttttaattgggtcggcaataatatagtcagcaatcttgcggtccgtcacacttaaattcggataataagaccgaattaaagtcaggacccgattgcgatgtactggtgattgtgtgtgggacatttcggccacctccatgaccaaattttaccacaattcttaataacaccctaaacttcctcacaggtgccaccgtcacaaactcttgaacactgtccagtccacaacaactgaacctcgttgccgctcattcgacagtccccgtcgatactaagcccttacgagtctgtttcggcttatccaacatgtaagttctaatcaacgtgacaatttgcgcattttgaggtaaatcggagtgctgggcattcgtaccagtaaccgtaatctctgtaaaatgcttgacttgcccttgatagatatacttgccagcctcgacactccgcgctggaacaagaccgtccgaatcatagttttcggtaccgcgaccgaatacattgtcgctgacttgggcaatcgatcgcggtacttaataaagtcagctaacatttgtgtcttatgattcaaattagcttctgagaaattgtaaggtgagccaatggtcataattcgtttgaccttaatatcgtcgcgattaaaatagtgttcaaagtagtacgtataaatcagaccaccattcgagtgaccaattgctttgaaattattgaattgatacttggcagccaacttcttaaaggccagtgagaaccaacgggcctgatgcttaatattatcatagccgtcacgattattttgaaagccaacgacgatgattggctcgttatcacgggcacgcaacgaccccgtcattttaatcgtatcatccgtcatcacggtcagcttaattaaactatgccgacgatgatcagccttattaagttgcttgactaaggtgtcaaaccgattctgagtcgcactactgccgggaatcataataattggtgacatctgcgaatcatggcgtcccgccatcgcagccacgttggttttcgtccactggtatgagggctgaatcaaaaagcccagaaatagtaagcctaatacaagcactaacagacttcgccgccgtcgctgccaatttaggtcgattatacatgcttagcacccccacttgtgcttgcgccgcccgcacaatggtttccgccaaccgcatgaacggcaaatagatcaccactgatagtgccaaatcaacgataccaagtaaaagtgccaccacgttaccgttagtgccgataaaggcaatcaacggtcccggcgtacccacgggaaccggataaaccacgggtggaatccaatgaaacccaattgccagcgccgccagtcccatatttacgacaggcgcaagcacaaatggtattagatagattggattatatagaactggtaagcctgtcagtagcggtccattactattaaagagcgcgggtaatagactccaccgcgcgactacgtggtagttatgattgttgctaccgatataaatggcaatcactaaggccagcaacatccccgttccgccaaacgtcccaaatgcgtgatacaacgtgttggccgtatacggatacggcacgtgatacgccgcagtgatgtgtgagtgcataattcaaattggccgtcattgtcgcactgttagtcaccaagcgttcttggtacggaccagctagtccaagaatttctaacaacagcgtcacaactgccatgccaaaggtcagccacagactgtgactagtcgttgcgtacttttgaaatgccgaccaactttcagcagagtacgtaataatcatcagccagttcaaagcgaggctcactagcacggccaatactagtattaaggccattggaagtagtgaactgaaagtccgtgttaagatatcggccgtatgcggactactttgtgccggaaccggcttgctgaaccatttgaagagcaaaggccggtcaaaccacccacaatcaatgcgcccgttagaccgttagtcccgatcaataaagtgttaaaaacgccaatttgattttgattcgtatactgataagccacgatcaatagcgcaatcgcggcggtcaatcccgctagttggtcaatcgcgctgattgagtttggcatggtattttgccgcaccaaatgctgctactacggccacaccgttgagcgtcaaggttgttaaactatcaaacggatagtgtaagtaacgatagtatgggacccattttgacaggtgaaagatactggcaataaaccccgttttcgtcaacacggtcagttgaatgatttgactgaacgtcccaatcaaaatgaatgggaacgtcaacatcaaggtccgttgaataatccgatagaagttagtttgccgaaaacgcaacaagcgcggcactaaccgttgaattaaccgttgttcatcaagccacacaataccgcccccattccggtaatctactgaacttcattataagccgttttagacgctgctgcctattaaaatctgttataaatttacatgctatgctggtatcaaccatacttatatcggattgttaatttaatctgactggtcaacaacggtgtggcttacgctgagacagctaatctgattacaccaaaaaggccacgccgtaattgcagcgtggccccgtcacctaaatttgatcgattatcgccaattgatcttgctgagaacgcgttttcctaagccattttgcagaacaatgaacaccggatacgcactgatcatcagtggtaggtaaatcacagctaacgaccaatctaataggttaaccaatgagaaaattcgtccggcaaacaaaaagactaggacgaacagtgttgccattaacacgactaacccaattttgaaccgattcaacggccgggctgcaatcaataacgcatttaaactaaagatcccggtcatcaacacactcaacgtcgcggtcgtttcgaaattcagctggaacttattacctaacaccatgatgaccatgatatagccgaccacgcagatcgccgcgggaacggcaatctccatcacctgtttcataaagcgcccggtaattcgcgtataatcaggctgtaacgccaagaaaacaggttggaataccaaccatcaacgatgaaatcggtgttaattggatgggctcaaacgggtagctgtggctcatgaagataaaaatcaacgtcagagcgaccgaatacatcgtcttaatcaagtagagcgcggcgacccgttcaatattattgataacgcggcgaccctcgttcagcacttgcaccatcgcatcaaagttcgaatcgattaagacaaaatcagccaaactcttcgtggcttcactcccactcgccatcgcgatactacaatccgcctgtttcagcgccaacaaatcattaacgccgtcaccagtcatcgctacggtatggccgttgcgctgataggctttaattagttgctctttttgttgcggcgtcactcgaccgaacaccgtataatttgtcactagctgatcatagtcgggagtagtccccacttgactcatatcaaccagccgatcagcgtctttgatttcagcccgttgtgcaatactagcgacccgtcaccggattatcaccagaaataacttttagggcgacgtcttgattagcaaaaaaaccaaacgtcgtcttagcgtgtggccgcaactcatccgtaatcagaattaatcccaaagtcatcggtcgagtcggtttgggcgtcgttaaggcggccacttcggctaacactaatacccggtaaccttgttgcgcgagcgttttgatgcgagactgtaactcgccgggtaccgtggtaaaaataaattccggtgcgcccataacgtaagcgtgaccatcaaacgcagccccactccacttacgacttgaagaaaagggaagaacttctgtcgcttgcactggtggctgaccaaaagcagtcttgatggcccgggccgtttcattatcatcatcaatagcagtgactaacgcagctaaccggtgctccactgctgtcaaatcatgctggttccacggctcaacgcgttcaaaaactaacttgccactagtaatcgttccagtcttgtgtcgaggcacaacgtatcgacccgggccagtgcttcaatggcgggtagctcccgcaccaatacctggtgccggcctaaagtgaacgccccagcagctaaagcgactgacgttaacagcaccagtccttccggaatcatcccgaccatcgcggccaccgtcccgaggattgcccggttctgactttcaccccgcatcatagtggaaatgaacagtccagcacctagtggaataatcgtaaaagtcaaaattttgataattcgattgataatcgttaacaattgacttggcgtccgccgtttttgcttagctgctcgcgccatctgcttgataaaactgccgtgaccaacctgcgttgctgcacgattccgtgaccaccaaggatgacactcccagaaaccagctcatcacccggccccttaataaccggatcagcctcaccagtaatctgggactcatcgacctctaatccagcggtcgcccgcacgagcccatccaacaggaatctgctcgccacgggtcactaatagtaaatcatcctgaacgatttcgttctgaccaatcgccaccgtttgaccgtcacggcggacttgaaccttagtggccgataataatgccagcttatcgacctgacgcttggcacgaatctcctgaaaaataccgatggccgtgttgacgatgaccacgaataagaacagcatgttcttatagcttcccgtcaaaaagactaatccggctaacaaaacattgatacagttaaaaagtgttagcaaattatcacgaaaaatctgtttaacagaccgcgttaagggcggtaacggctcattctttagacccgctgtcaggcgctggtcaacttgcttagtcgttaacccgtgttcaattgctgataaataacgttccgacatggtgggcccccttaaaattaactttaaccttattgtaaacgattttttaagcctggggccaaaataacgccctaatttagcgtttacctattatgcagaattaagattttcattacgattgatcataaaactacttcaataaatcattattgattttgatttcagccttaacaaagattattgtattacgccccatttactgctaaatattggcgaatttaacctataaaaaaacggctatctgctaagatagccgcactgaatcttaaattattttttcgtcttatcagcgggtaagtgtgtctggtcaatcgctaactgcataaccttcgtgaaccgttcatcaagttcagtccccgcatcttaaagaagccgccaatctcttggataatgaatccgaacaacgtggaacggtacaaggtattctccacccgcgccgaatcatccaattgtaatggtttaaacatatcctggtataactgcacaattgctttacgagaccgtgggattcttaggttatcatttaagtcaagtaataacggtgccaacccccgatgctggttgcgaggccgcccggaattcttgagcaaacatgccatcaaagcctcatcaccgtcaacgtctgagattgtttcagttaaacgatccgcaacattttgaacaaattggaggccaacctgatctaataaatcactcaagctatcaacataattataaatcgattgcggccgcacatccaaaactaacgctaaatcccgaattgttaatccgttaattcccttgctttcaattaactgattagctgttgctaatacttttgcctgtgtcagtgttcttctctttaccatcatgctcccccatttatcggtttatttcgtttatcattataacccaaactggtcaaaaaccgagatgaaatacatacttttatcaaaagtaatacaattgatggtttttgtgggtgtttttgaccaataaatacaattatttaatttaatacgctaaatttgactcaaacagctccagtgaactagtttacagcaattacagcgcattatttattaaattatttaaagcaataattataattatcaataaactgttttattagccgattctaaatgatctgtctattaaaatcggacgaattcaaatcaatatcagcgcttaaaaacggttattttgtgcttctaattcaaagttagccctcaagctgagtaaaaaagtgtgttggttacccgacaaataatcaggcacccaacacacttttcataatttcattaataatccagttttaaaatgcttattgttcgcgttctaacaccgttaccgattcaatatgtggtgtttgtgggaactggtccacgggttggaccggggcactaatatggtagccgtattctgcaaaccgttgggcgtctcgaactaaggttgatgggttacaactaatgtaaaccacccgtttaggcgccatttcaccggcactcttgataaagtcggcgtccaagcccttacgtggcggatcaacgacgatcacgtccggcttaacgccatctgcttgccatttagccatggctttttcagcgctatcccaaaacaaaggtcgcgttcgtaataccattcttatccgcattctgccgtgcgttatcgatggctgctggcacgatttcaacaccatacacttgcttggcatgttgggccatcgttaacgaaatcgttccgataccggaataagcatcgatcaccgtctcattacccgtcaaaccagcttgatcaatggctaactgataaagcttttcggtctgttgtgggttcacttgatagaaggactgggctgaaatggcgaatgtcaggcccagtaactgatcatcgatagtggccttaccagttaacacgttgttaactggccctaagatcacgttagtcttcttagaattaacgttttgaatcacactgacaacttcaggtaacgctgcttgaatctcttgtgtgaccacgtcagccattggtaagtgtttcgttcgcgtcacaataacaaccatcatctcatgactgtaatacccacgccgtaccatgatcgtccgaatcgtccccactatgatggaattcatcgtaggctgcctcgtgatatttccgtaaaatatcgcgaactaccacgatagccttatcaattgcgggatcttgaatataataatcttcaattggcatcaattgatgactgttcttcttgtaaaaaccagtcgttagttgtccttggacttgtcgtacgggtacttgggccttgttccgatactgcgtcgggttggccataccaatcgttggtaaaacttcgacatcatccatgtggacctttgcaaataattcggccacctggtgctgtttaaacttcaattgttcactgtattccaagtgttgtagtggtgcaatcccggtttgacgataaacgcgccctttaggattaacccgatgaggactcacttggttaatcttttccacatcaccaaacgcaaagttcttcgtcgtcttcgtgaccttgaccgtaatttttttcttctggcaatgcattttcgataaagattgggtaattatcgactttagcaacacccataccctgataggttaaatccatgatagtgacgtctaaaacttcacccttgtgcactggtaaattaactttcatttgtttcctcttgctttctttgttagtgacttattatttttagttactgcctggtagccactgctccgggcagcgagtgatatggccattaatactgccacacttggcagtgtcgttaacatttactgattaaacatgctattcaaattgcttactgtgagtgtcaaaacgcgcgaatttgagctgtctcatgctttgcaccactgacaaatcattgctaaaccgacaaacgattaaatcgttaggcaatgctcaatcatgtccctgtgacggtaacacttttaaaaaaattaccgtccaccattgtatcggtaaacggtaatttaagcaagttattctgtttttcgtcgtcctcagttgcagctggcaactgatcaacggctgagacaaagtgtcgctcagcgtcttccaactctggatctgtatccgtgattgcctcatcggggatccgatccgtatcggcaaacatttcgatatgttgcttcaaattccggaacgtcatcggtgcatcaccaccgtactccccatccaagttgatcattaagcgatccttgtcagctggtttggcgacgactttgctcgtcttcacataaataatgcttggatcattgatatgcttgccaccattgagcactaatgtcattaagtgaagcattttggcaaggttgctcgtcttcacaataatcatggtaaatttaccatcatctaatgacgcgtccggcactaactgctcaaagccaccaactgaattagtcagcgctaagaaaaacatcgaagccttgccctgataatgaccaccatcatatttcaaatccatctcaactggttttactcgtggtaataactcagcacccttggctaagtatgccgcgtacccaaaaatcgacttcaattgtgatggtacgtcataggtcagctccgttaacatgcccccagccgcaatgttaatgaaatactgttcaccagcctgaccgatatccatcttaaccgtctggttctttaggactaccttggccgccgcaaccggatcattgcgcggaatccgcagtgcccgggcataatcgttggtcgtacccgccggaataatagccatcttaggacgccgctttaacccggctaacccgtttactacttgattgatggtcccatcaccaccagctgctacaatcagttcaaacccgtccttggcacaacgtcgcgcttcatcagccgccgaattaggggcgggcgtcgttgcgaacgcactggtctcataaccagcttgttcaaagataccaagaatttcaactaaatcgtgggccaatgcctcacgtccagaagtcgggttataaataagtcgtgcccgtttacgcatgtttcctattcctccgctcacacggtcaagcgttcagcgtctcatctctaccccaacgctggacatgcatcaatcgaggctcaacaccttatcgaccaacgcttctaccgtgcttttaatgatgtcattaatagttggttgacgactttcgggttagcttgaccacgtgtcttcttcatgatttgacccacgaggaacccaacggcccggtctttcccgttcttaaagtcatcaattgattgttgattattatccaatacgtcgtcaacgattggttgtaacttcgccggatcagacaattggactaagcccttgtcgttgacccattggacaggctctgagcccgccataatggccttaaagaccttcttagcaattttacttgagatggtttcatctgaaatcatcttgatcatcccagctaagttagttggcgttaagtcagtcgctaacaaatcaactttatgctcgttcaagtacgcgttaacgtccccttgcaagtagtttgaagctaatttaggatccgcaccttcagcaacggttgcatcaaagaagtcagacatttccttagtttgggtcaacacacccgcatcataagcagttaaaccaaattcattgatgtaacgttcacgccgcgaaccaggcatttctggaatggtcttcttaacggatgcaatccagtcatcatcgatatcgactgctggaatatcaggttctgggaagtaacggtaatcatcgctaccttccttgacccgcatcaagatcgtttggcccgttgtttcatcaaaacgccgcgtttcttgttggatcttgccacccgccatgagaacttgttgttggcgttgttcttcatattctaacgacttgcgcacgtagttgaaggagttcaagttcttcatttcggtcttcacaccatacttgtcggaaccggccggccgaattgaaatgttaacatcgacccgcattgaaccttcttccatcttaacgtccgaaacgcccgtaaattggatccgttgccgcaacgcttcacagtaagcataagcttcttctgggggaggcaatgttaggcttagaaacaatttcaattagcggcgtcccttgccggttcaaatcgacataggaatagtcgttttcatgggtgtttttcccggcatcttcttcaatatgcatctcttcgataccgatttttttctttttaccatcaacttcgatttcaatccaaccatcatgcgcaattggtttttcatgttgcgtaatttggtaggccttcgggttatccgggtaaaaatagttcttccggtcaaagtacgtgtgatgttcgatttcagcatgtaaagccgttgctgctttaatcccagcttcgaccacgcccttgttaggcgttggcaataccccggatacccccagtcgatcacgttcgtgttggcatttggttcggaaccaaattgcacgggtgaaggactaaagatttttgagttcgtttttaattcaacgtggacttccaaaccaatcgtggttacaaaattcattagttagcacctccgactttgcttcggggtttgcttgtaaacttgcgttgcttgttcaaaggcatagcccgctcgatacattgtgctttcatcaaacgccttaccaattaattgcaagccaactggtaacccgtctgcaaacccagctggtactgacattcctggtaacccagccaagttgactggaatcgtcaagacatcgttcatatacatcgtaattggatcagataattcgtcacccaacttaaaggctggcgttggtgcaactggtcccataatcaaatcgtagtcttcaaagaccttattaaagtcattgataatcatcgtccgaacttgaccagctttgtggaagtacgcatcgtaataaccagctgacaaggagaaggtccctaacataatccggcgcttaacttcatcaccaaagccctcggaacgactacggacatagacatcttccaaattcttaacatcgtcagcccggaaaccgtaacgaatcccgtcaaaccgttgtaagtttgaagcaaagcttctgaagatgcaatgatgtagtaagcagccacaccatagcgactgtttggtaaggagacttcttcaaccgtagcacctaagtcttcaaactgcttgactgcttgttgaatgacttcacgaactttagggtcgatcccctcgcccatgtattcttttggtaacccgatcttcatacccttgatatcacccgtcaaaccggccgtaaagtctggtacagtttgtttggatgacgtagtatcatgcacatcgttacccgcaatcatattcaaagcggccgcgttatccttgaccgtccgtgtcattgggccaatttgatctaatgaagatccaaaggcaatcagcccccagcgcgagacccgaccgtacgttggtttcatgccgacaattccgttaaatgatgatggttgccgaatcgaaccacccgtatcagaaccgagtgccactggcacttgtccagaagccactgcgacagctgagccacctgaagacccaccggagcactcgactgatgtcccaaggattacgagtgacatggaacgccgacgtttcagttgaccctcccatggcaaattcatccatgttggtcttaccaacgatcaaagcgttgcttgctaatagtttgtcaaccaccgtggcattatagaccggcacgaagttttccaacattttggaagccgccgtcgtcgttaggcccttcgtcacaatattatccttgactgccatcggaatcccagcaaaaacgttgttcgcgtcgatgccatcctgatccaaagcagccgcctgttgtaaggcctgttcttcatttaaattcaagaacgcccctagcttagggtcaacctgattcatattcgcaaaagtggccttcgctagttccgtagcactgatcttcttggctaccaagtcagcgtgcagactagttagatcttggtcgaaataagtcattattcaccgtccccactttcatcaataattgctggcactttgatcaagccattgggccgtttctggagcattcttcagcaatgcttcccggagtgcttcatcactcttaactgccacgtcttcacgtagcgtattcgtatgatcactcatccgtgacgtaacgggtacacccgtggtatcaactgtgcttaattcttcgaacatgccgataatttttttctagttgcggtgtgaacatcgctaattggtctggtgtaaactccaatttggctaagctcgccacgtgttgcacttgttcggcattaattcgttcttcagccatcagatttccttctttctcaaatcttactcaatattattgtttaatcgtcgccctggtcactaaagacatgggtgtaatacgaactacccttcgccgttctggctaagaagctttgaatgtcaccattggcactcttaaccgtaatttcaaccggtacaccagatggcaagtaccgtttagcagccgttgctaagtactgcgtgaaactgataatttccgtttcgctgtacgagaacttagtcgtgatgttgacacttaatttactcaacgatttgtccttgtaatgagcattcgccgttacgccagacaagttcgggaagaaattctgcacgtgggacttaaactgactaaagtccgactcatcattactattcgcacctgagttctttgactcagaggtcgctgggaagacataattcttccaattcaacgacgtccagtttgagatcgaagtggagccgttcttagaaaccgcgtaggcaatcatgtcgcccccaactaaactatcattcgaagactgcttatagagtgccaagacaatcggcacattcttcaaagctgagcgttgccgcaaccgctgtaagacagtattcgccatcttcttaccttgcgccgttaactcagtcgttgagatgtccgtttcgtatgttgccccatattcgaccttagtataataatcgaccgagttcattcccaagccaatcgtgaccccgccaagcgataacttactacccattttgaaccatataatcttgttcttcaagctgttgtaagtaaatcggattccgagtattcggatccttcttaccgttattctctgggttcaagccctccgaattgctgcttgatttccgtccgagccaattttcaactgtcgatgagctcaaatactgcccttcttgaaagacatacttactcgttggaaagaccttttagacacgtccaataagccactttcgaagctcttcaaattcatgacgttatcattttgcgaaacgaccacgcctcgcgacttactcgtccgataacggccatttttgatgacgccttgatagaactcactatcagcagttccagtggtggtcgttgttttcgttccggtcgttgtggtgctactactagtcgacccaaaggacgaattctttaaattaccgcgtgcggctagaacaatggcagctactgccactaagccaatcgtgcgtatgcgtttaacattcacgcttgtgcatcctccctcattgtttcgctgaaccgggcttcatcccatacagtaatgtccagctgctgtgctttttgcaacttgcttccggcatcgctacccgcaatcacgagatccgtctttttagagacgcttcccgtaaccgtggcgccgtgagcttgtagccattgagtcgcatctggccttgtaaagctttccagcttaccagttaacacgacccgcttgcccgcaaaccaactgttactatcttctgccacggtggcactagggccttgataagtggtattcacgttgactgcttgcaattcgcggatgagtgtatgaacttcgtcgctctcaaaatattgaaccactgcgttcgcaatcacatcgcccatcgaatcgatcgccgcaatctcttcttggctagctgccatcaacgcctcaatcgtcccaaaatgctgcgcgattaaccgcgccactttagcaccaacgtgccgaataccaagaccgaacaataaccgttcaagtgaacttatcacggctacggtcaattgctgtcaagagcttttcagcagatttatcttttattttatctaatgttaacagttgtgccttagttaatcggtacaaaccagcaacgtcactaaccagccgatttgcatagagttgcgcaatgattcgtggtcccaagccatcgatattcatggcattgcgagaggcaaaatgaaccagcccttcttggacttgtgctggacatttcgggttaatacaccgtaaagccacttcgtcttccaaatgaaccagcggcgccccacaagacggacacgtggttggaataactaatggttgcgcatccttgggtcgtttggctaaatcaaccgatgaaatttccggaataatatcgccagccttgtgtagcaagaccgtatcaccgatgcggacatctttggccgccacgtaatcgggattgtgtaacgaagcccgcgcaaccgtcgtcccagctagttgaacgggttccataaccgcagttagggcgtaacgactcctgtacggccaacggtccattcaacatcctttaaaagggtcggctgctcatcaggtggaaacttaaaggcaatcgcccatcgtggcaccttgactgtcgctcctagtgagcgttgcagcggtaacgggttagctttgatcacgatgccatcaatgccatatgctaattctggccgttcattttgataatggtcaatgtaactaaagacatcggccatcgaatgggccaccttaaagtcaggattgatggcaaaaccaagatctgcgaactccgttaacatgtcactctgcgtacgggcggttaacggttcatagtcggcaatgttatacataaacgtgctgagctgtcgttccgccacgactcgtgaatctagctgccgtaacgtaccggccgcagcattgcgtggattcgcaaagactggttctcccgctgcttctcggcgttcattcaaggcagcaaacgctgccttaggcatataacattcccggcccacgtacatcgatcgtcagtggtcgggtcaaccgttgtggaatcgacttgattgtcttaatattagccgtaatatcttcgccaaccgtaccgttaccccgcgtggacccttgaacgagcaccccatcttcgtaacgtaacgacagcgctaaaccatcaattttcaactcacaattataatcgactggatgaccaacgttttgttccaagcgatcaacaaactcttgtaactcagcttgtgaaaagacgtcgcccaatgacaacatcggaatctcatgggtcactttatcaaagctcgctttaaccgttccaccaactaattgcgtcggtgaatccggtgtaacgagctgtggaaaagtttgttcgagttcgaccaaccgttcatacttttgatcatacacactatcttcaacgttcggcgcatcttcgtcatagtactgccgacgccattcatttaacgtttgccgtaaagcagccgcttcatcagccgcccgctcaaccgtcattgtgttgggtttgtccgccatcagccagtcctcctaactagtcctgtactttttggatcggtgcaaatgcggctaataaccgcttgattccttcagatttgaaagcaatgtctagttcagcatcttcaccagcaccggagaccttcacgaccgttccggttccccacttacgatgcttgactttatcaccgatcgaccaactattcttgtcagcacccgtgccactagccttcttgaccgtggcccgcgtccccactggattctttttatatgaaggtgtaaaagcacgccgttcacgatccgcaccaaatgggactttaggaccagtgctacttgcaccatccaacgtattttcatttttgagtaattctggttcgatttcttcaacgaaacgggaagccggattattctgccgccgaccgtaaagcatccgtgagtatgcattggtcaagtacagcttcttctcagcccgcgtaatcccaacgtatgctataacccgttcttcttccagctcgtcttcatccatcattgcccgggacagtgggaagataccttcttccatcccaatcaagaaaacaaccggaaattctagccccttcgctgcatgtaacgtcatcagcgtcacggcttggggttcttcctcaacgttatccacatccgaaaccagtgctaaatccgctaagaagtccacgaatttgtcactatcttcatcttcaggttgataactatcatcgaattgtttggtgacagacaagaattcttcaatgttttcgatacgggcttgtgcctctaacgatttcgttgccttagcatctttcaacgccttcatgtaacccgttcggtcaagaatctcttgtgttaaatccgtcacggataagtattcccgcatagcgcgcaattcattcatcgtcgctgcaaacttcgctaaagcacccttcgctcgtgctgaaatgccattagccatgtcaacattgctagctgcttccaacatggaataacccgcttcatccgcgaacaaccgcaatttttcaacactcgtttgaccaatgccgcgcttaggttcattaacgacccgttcaaagttcattgaatcttgatcgttcactgccaaagtcaagtaggataagacgtcccgaatttctttacggtcatagaacttattaccaccgaccattgtataagggatgttcgccttaacgagtgactcttccattacccgggattgtgcgttcgtccgataaaggatcgcaaaatcgccgtagtccattttgtcctgctgcatgctttcttgaatcttggcaatgacaaagtgagtttcatcactttcactctgaccacgataataagaaatcttgtcacccggttcattctcagtccataatttcttcggccgccgcgttgaattattgttaataactgcattagccgccgacaaaattgtcttggtcgaacgatagttttgctccaacatcaccgtgtcagcttgcggataatccttttcgaaatcgagaatattttccatgttggcccccgccaaccatagatagattgatccgcatccccaactacacataaatttttatatttgtcagctaacaagttgactaacgtatactgtgcattattagtatcttgatattcatccacgtgaatataatggaatttgttttggtaccacgccagcgtttcaggattctgcttgaataattgaatcgtcagcataatcagatcatcaaagtcaacggcttgatcagccgctaattcacgttggtattgcaaataaacgtctgccacgacactctcaaagggactggcagccgattctttatacatctccggcgtttgtaagtcatttttcgcatttgaaattgcggataagattgaccgcggatcaaattttttcgaatcgatattttgttccgtcaagattcgtttgactaaggtccgttgctcgctagtgccggcgattgtgaacgctcggttatacccgatttgttcaatgtcacgtcgtaaaattcggacacacagggcatggaacgttgagacccagacctcctgcgccgattcacctaacagcttaccaacccgttcacgcatttcgcgtgcggccttgttcgtaaacgtaatcgctaaaacattccaggggttgaccccttgctcttcaattaaataagctacccggtgcgtcaatacacgggtcttccccgagcccgcaccggccataattagtagcggtccttctgtgtctaaaacggcttcttgctgcttgtcattcattcccgccaataggctttctttcgacacgctgttcgccaccctttctaaaaatcagtcaccaaacattatagcaaattttggccgtgattgctgtactttaaggtcagcatctcataaaaaaatcgcggtttttccattgtcagtgacacctatgttaattttacaacttctactattcacgggaaacgaattgacggcaatacctttgcgtaactttaagtaattttgagactccctcaatttctaaccaaaatacccgccacgccaatctcaacgattcccctcagataaccgtatctcgccatttggctggcttctccccaaccgctaaaaaaatccaattcacaaaatgaattggatttcgaactttatttattcacgacggttacccataatagctggtcacccggtgcgaacagtacgattagtttaaccgtaataatccgtaaaactaggttctgatcatacactactcagcttcaggttcattatcagccggcgtcgtttgcccaaactgccaaatacttgtgtcttcgatctgttcgagtgcttctttaacacttggtgcttcgactagcacgtggccagcgactggtgcccggtgcgcttgtaacaacgttcggtgatagaaattaaagaaccagttcgtcttaatctgccactgcgtgcgaatgccactctcctgagccggtgtaaagtaagcagcagcaaccacgggcatcaactgcttgactggcattaacggcagtcccgcaattgctcgcaagtgttgttctgccatactaatattcgtagcacgttcgaagacataacccgcctgatgcatcgcggggacaatccgcttcacgtataaattaccactcttcgttaagaagaaggcaacttcaaagacacccgtataactcaagttatcactaatttcctttgtgatccgcagcatttcgtcattcacagctgaatcaatttgagctggcacaatcgaggcaactagctcatgattacgataccggttttcaacggttgggaagaaagctgtcgtatcaccactcttagcgccaaaaacggagagttccttatcatatggaatcaatgactctaacaagtatgtgccccaatccaacagatcagccgccttgacaatatccgtctgcgtcttaatgaccagttgccgattttgacccaagcccttttgaatcggcttcaaaatactaggatatccaattgacccgatcgattgatagacatcatccaaactgacaattgtcgctgacggtgctacattcaagttaagttggctgaaaaacgcccgttccaaagagcggtcctgtgtaatctcaagcgcatcggcgccttgtggaacccgggtatgggccgccaaaaattaatgaccgacgcatcaatggtttccgactcgtaagtcaccatatcacaacgttctgcgaagttctgtaactgttgttgatcattgagggccccgacaacgcgaaaatctgccagttccatggtctcagtattttcgttatcgccgtataccccgacattgatgccagcattacgcgcggcaattactaatccaacaccattagtactacttccaataatgccaagcgtaccacctgggtttaaaatcgagttgtccacttcagtccctactttcctatgctttaaataattataatctgattattgaattattttaacgctcattatcctgtaacaatcatacttgctgacacgcacagttgcaagtttatcactgctttttcggcgagcattgcgtcgcttaactcgcttgagccaaaagccaccggagatgtagcgtggttcatacgcgatcacaaacgcattgggcgccgcgtctttaatcaggccatacagccgccgttcgttcttccgtggggccaaaatttctagttctagccgctcaccttctagaccataagcagcgtgttgtgtgaccccaaagccattttcacggagcactcccggtaacgacgacttgggatcaggtaaaatgactgaaatcattgtataccctaacgctaatcgatcttcaattaccatcccaacatacaccccgacaccgtaacctaacgcgtatacgactaaattgatcggattattgagacgatttaagaccaatgataatcctagcacataaatcgtaatctcaatgacacttgcaaaagctgcaaaataccgataaccccccgcattacaagcaaaaaacgtacggtgtttaacgtaatgtaagcaaagttgatgatgaaaataaggactagcatccccatgtcaatgtgcatcacaatccccgctttcttaacttaagcctgggtgtcctccgatgcaaagtgcacccggtcaccatcaaatgacgtaatctgtgctagtgattctaaacggacaccccgatcagcaatcagttgatgacccgtttggaagactttttcaatcacaataccgacacccgcaatttttacgtgcgctttatcacagatttcaaacatcccttgaaccgcctgaccattggccaaaaagtcgtcaattaacaagacttggtcatccgcctgtaagaacttcttggcaatcgagatgtggttagacgtcttcttcgtgtaagaataaacttcggctgtatataaatcatcaattaacgtgacagatttgtgcttacgtgcgaacacaacgggcacgtgcattgctaacccacgccatgactgccggcgcaattcctgatgattcaaccgtcaagattttcgttacacccgcatcttgaaacaagtgggcaaattccgttcccatggcaaacatcaggtcgggatcaacttggtgattcaaaaagccgtccactttcaatacttcaccgggaagtacccggccatctttcaaaatgcgttcttcaagttctcgcatagtaccctcctagaattataagcgacattgaaatactgctattaatttcattactttctatcataccgttgtaagtcatatttttgaataatattaattaatttttgtgcataacttggatcagtcgcatatccagccgtctgcaatgcttgcgcagctgtctgataatcagttgccttaatcaccgcagcgtagtgctgagaatcccaagtcgttccgtacgccaatttcttggcatgatcgaccagcgaagcgtgccagctatcataaacggcgaagcgccgtttgaccgtaatgataggccccgtcataatactcctgcgtcgtcatgagccgtcccgacgtggacttaaccccaaataaattattattctctgtcgcattggtactttgtccccaatccgattccaaaatcgcctgacttagcgtgatactagccagcacgtggtattgctgatcaagctgttgcgcagctggtactagctttttaataaatgccgcatgcgttgttgtaggtgttgtcgccgtaacccgcgacttaaccgcccaattatgctgaatataccaaaccatccccaccatcgccgccaacactaataagatattgacccactgaaggcggcccttcttcacaaataattgtgtctttgtccgttgcttccggcgcgattttcgccgcttacccgccatcatagccgcctcctttctggtaattgccttacagattacacctgttcatttatcatgaattaggattaaaacatgctggtttcttagttcaaaagctgccagcttaggccaactgtaaaaagtgcgcgttagtgtaaacgtgtttagattaagactcgtatttgagatgacgcgggttgggcgttagctcaaatcgacatcggctgcgttccagtaattgtcacccggccccgaaagtcggcataagacgcgcacgtgctgacgaataagaatccaactaaccaacatgttttaattctaagtaagcctaaatcgcaatgagcatcggtcatattacactctattttaccgacttttgaattaattttacatgattattgggcgccaattccttatttttttgctaaaatgtaagtggtcacattcgattaatcctaggaggaacctataatgtcgaaaacttatcgctgggccattgttggccttggtaacatcgcgcacagtttcgttaaatattttgatcaacctgacggagaaatctacgccgtttgctcacgttcgcaggataaagctaacgcctttgctgctgaacacaatattcccccaaagcttatggtaatttagacgagctactggctgatgaacaagtcgacatcgtttacgtggcaacgccccataattatcacattgacacgattttacccgccttacgtgctggcaaacacgtcctcagtgaaaaggccatcacaatgtctagcacccaactcgcaatcgccaaggaagtggctgctagcaaccaccttatcttagcggaagcgatgaccctctatcacatgccattatacgagaagctccatgattttgcggcagaacgtcatcttggtgatctgaaaatgatccaagctagctttggtagttttaaagaaccggacccaactaatcgcttctttaatcccgaccttgccggcggtgctttactggacattggtgtctatgccctagccttcgtggaagaattcttgactgctaaaccatacattacaggaacaaccatgcaccgattcagcagtggcgtcgatgaatcttcgacaatcacgttacgaaacgccaatgatgaactggccaccgttgccttaacgttccgagctaaaatgcctaaacgcggtatcgtcgcgtatgagaatggttactttaccgttgatacctatccacgtgccgacagtgccactttcaccgacagcgaaggccatactgaaaccatcacagccggcgatagcactaacgccatgaattacgaaattgctgacatgcaaaaatggttgctggcgaattacacaacacgagtcttgctaaaacgactgacgttatggatatcatgactgccgctcgtgcacaatgggacttccgctatccatttgaaaactagttataaataacatctttatgtaaattaaaaaagcttagataccgtgtgttttttcacacgatatctaagcttttttacccccgtgaaataccattgaaaaaccccaagccataaaatcagaaagccagcttggactcgctgggaaaaatactgcttagtatcaacttggttagtttgggcttttctcaaagccatactcgtttattgaaggactagttaaaaatcagtcctaagcccatgaaaacgataaatgaaagacaaatcaacgttgcgtttttaattgaaatcgtgaaagtttctcgtttgacctgtttgtgcaagaagacccgcgtatttttccaaactggaataatactgagcaacgttagtaaactaaactttggtagcacacccatcaagaccgcaatcaccagacaagcataaccagcaacgtaactccatgcaaatacctgaagcatcaccggtttgccaaggtaatacaaaatcgtgtgtcggcctaacgcaatgtcctcgtccatatcacaaatattattagctaacataatgttagaaattgcaaaaatggccagacctgacgcaattaaaacagccagcgttgactgccaagtaatggctgccgtgtcatacgtattaataaagacagcaatccagaagatcataaagcccatcgtaaaggcccgagaaaaattcgccaaacgggccttgtgaaattggcttcggtccgccagcgtaaaagtaaccgaccgcatatgaatatagccccatccacaacaacggcaaccccgtttgtgttactaaccatagtccgataatcaatgagattccggctaaaccaaacgtaatcgtccgggcctgaccaatggaaatctggttaacaccgaccacattagtctcttgcaaaaattcttgattgtcgtcattacgtggcgcgtgtaggaagtcttggtaattatcattcgcattagtcgccatgtgaaaaagtgaagatgcaatgaaaaatagcaataaataaccaagatgtaactgatgataattataataggcgtacatactccccaaaacgaacggtaacacgctcgcaattaatgatttaatttcaacaaattcaagaaacacttttggtttcaatgatttacaccatccttttgtttgacaacgaaacaagttatttgtaccctttaatatagattgtattttagaatgtgactggctgcaagtgttggcgtcaaaacgtcccggagccatctctcaaataaagcggggtattttgattatgatgcaaaccatttggcaaccggaaagtcttgtcgcaaaggagctagcagcgctgaagccgtatctagctactaacgtaaaaattgataacgccgccattaatgaccgcgtacacgacttactcgctgcgggtggtaagtttttacgcccgggcttcttttacttgtttagtcaatttggaccggatcataacacggcccggttacgtgctggcgcagcggctatggaactactacacgtggcgacactgattcacgatgatgtaattgatgaatcgccagaacgccgccatgtgacaacgatccaccaagactacggtcaacgtaatgctatttacgccggtgatctgctgtttacccgctatttcgatcaagtcctgattgctgccaagacagctgacgacgttaaaatcaatactgcggcgatgcgagccatcctccaaggcgaactggatcaaatggcacataacttcgatccgacgaccacggtcgatgactacttagcaattgctcgtggcaaaacggcccgtctgttcagcctcagttgtgaacaaggtgcccacttcgcgggtgccgacgcaagcgtcgttaaactagcgcaacagattggtgaaaggatggggttagcctaccagatgttagatgacgtccttgactacgccggtgatgaggccttaactcaaaagccggtgcttaatgacttacgggacggcgtttattcactgccacttatctacgccctgaccgctgaaccacaattggccgaacaattaccccaacccggcgaccacatcagtaatgaacagctactgacaattcgcgatcaggtcattgctttgggggcgttacccaggcacaacaattggctactcactataccaaaaccgcactgaacctaatccgatcagctaccaactggtgaaacacaacaaactttacgccggctagtgactgaattactggttcgcaaccattaatacacaaattaaatcagcgcgtcaaagtaacctattactctgacgcgctgatttttcagctacaaccattactcaccctacaccgccgcgatttagtcaaaattgttatccattccgccgaaataaatagtattatagtgtttgtataaaaattgtaataacggggctatttttactaggaggggtttcatgaaaaagattgttaattggttgctggggagcgtactaatgatcgcagcggtcacaatgctaagttcagtatctgcgaatgccagcacttactatcatcgcacgccaacgcgggcaacggctagaaaggcctattatacgaccgataccaaatcacatacctttagggctaatggtaattataatcgttggacattcagggccaatcatgatttgaagaactatcgcaacaccgttctggacaacgactcagcaaactgatattatcatgcacggcaaaaaggttcgttactactgggttcacaatagcaagaatggggccactggctggatttggagtggctacttaaagccagttaaagccaaagctgccacctcatccgaagcaacactcgtctccagaatgcgcgtgtccaaaaaggctcagcaaatcgtgacggtcattcaaaatggctcatccacggccactcttaaactttggcaaaaaaccaatcgcggctggaagaatacactaacttccgcaagtcgcatcggggccgctggcatcggcaattctcacgaaggcagcagtaccacacccaaaggcgtttatcacttaagcttcgcatttggtaaagctgccagtgcaagaactagtggtatggcctatcgacagatcaaccggaaatcttactggattgaagatccacatgaccggcaatataacacttggcagaaccgaaactgggccaataataagaacgagcatctgatcgattacacgaaggccgcgccccacaatcagtatcaattagcgattgtgatggacaatcacggtcagcataatggctcgggcttctttattcacgtcaagaatcaatgggcaacggctggttgcgtctcaatcaattacaatgatgtacggaccttactcagccgcttaggcacgaaagcctacgtggtcgacgttcagaatcgggcacaattacaaaattactaacaggttaaatcataacctggcgattaattgcatataaaaggacttggtcacagcgaccaagtccttttacgctctaaatcggcggtgtaatcagtaatggtcatcatgaccactacattcgtaggctgaatacccattcagcgcagtaattaaaagtctgtttcacaagcccaaggtgcacgtgaggactgctatcaaccggattaccgatcattgttcgcatcatcacgcccttgatccaaatcataaaggcgttttaaaccgcggtgcgttcgcatacaattcgctcggcgtaccggccatatcgaattgaccatcttccaagaagcgaacttggtcgacatggttgaccccggccaaatggtgcgtgacccacagaatcgtcttatcatgcaagacccggaacaccgtggtcagcaaatgggcctcggtaatcggatcaagactaactgtcggttcatctaaaatgatgatgggcgcatcttgtaataagatgcgggctagcgcgagccgttgtcgttcgccaccagaaaagcgcgcaccgccctcttctacaactgtctcgtaaccatcggggagcgtgtcgatcaagggcgctaactcgactgctgctagtgcggctttaacttgttcgtcagtcgcttgcaagttacccatccgcacattgttcataatcgtggtattgaacaagtacggctgctgatccaagacgccgaataactgggcgcgctcattttgtaaccgtgtgatgggcacattcattcaattgaaccgtcccactatccggtgtcaggtcacctaaaatcagcttgagcaaggtactctttcccgttccggaaggtcctagcggggctaacttttcaccggcttttaaagtcagattcaaaccgtcaaaaatcgcatgaccaccttccgcatatttaaagtcaaggtccgcaatacgcaatacttgaaatggctccgttaagactgtctgatcgtgttcatcttcaggcgtggtgtctaaggcgttgactcgtttgattgaccgttgataacttggccactcactaacaccctgactaacagactgcatggcatcgaccaacgggaatacggagaggacaaacgccgcaatccaattggaactagccgcattcgttgtccagtaaaaactactccagatcaagagtgccaaacaaatcaccccgaaaatgatctgaatcgtaaaatctcgccaccactgaaagcgatggtcctgtttacgaagtgcgctgcaattgcttcgataggctgggtttgccgctcatagaaatccgtttgacgtccggcaatcaaccaatcaccgagccccattaccgaatcagtcagctgcgtataaaagccctgttgaatctgacgactgcgtgattcacgagcaccattcagtaagaccgaccatagcggcattatcacaacgaccaatcctaacatcaacaacatcaatagcccgaaccaccagctaaagtagcccagaccaatcacaatcactagcgtcatcaaccaggcaatcaccgttggaaaaacggtccgtaaatataaattttcaatatggtcaatatcgtcagctaaaatgctcaggacatcaccagtctggaaattttggcgaatcgctacggcgtgcttggcgacggattggtacagtttcttacgaaaatctgacacgatccgtagcacccagttatgactcgtaattcgctccgcatagcgaaaggcaggccgaccaatcccaaacagcgctctcgttagaacgattggcacataaatcatcagaatattatacgggtgtcgtgcggctttactgatcaagtagcccgagttgaacatcagcgctgaaccgcagaaaaatgtcattagacccaaaaacagcgtcagggctagtaactttttatacttgcgcaaatacggcatgacccaagtatcatttttaaaagttgccaaaaatctttcattagatcgcacctaccatttcatcacgtaaccgaacgtacgccccgtcatgcgcggccaattccgtcggtgtcccttgttcaacgatttccccatgatccatcactaacacgtaatccatctgattaatccagtgtaaccggtgagtcgcaaagaaaactaagtgattatcaagtacgggtaaaatcgtcgttttcagttccgcttcagtttcaatatccaagtgggcagttggttcatcaaataacagaactcgccgcgagtcgtcaagaaaggcccgcgccaaaagcaatccgttgcgcctgaccaccactgacaccacgggagccttcaccaatcgccgtatccaaccccgctggtaacgttgcaatccaggccgttaatccagcgttttcagcagctcgttcaatcgcttgacgtgaagcgtctggctgataaaaagcgatgttctctgctaacgttgcatggaacagatatgggttttgcggaatgtagaaaaagctctgctgccaggcgtcctggctcaaatgcgagactgtttgcaagttgacttgaattttaccctgatcagcgaccggggttagaaagccacctaacaaattgatcaaagttgatttgccggagccggatgccccaataatcccgatccgttggtaaccatgcacatcaatattaatgtgttttaaggccagctgatcatcatcatacttaaaatcaacgtcatgtaagcttaacgtactatcactttgccattgcacaggctgagtaccaagctgttgacgttcagttggcaccggcaaagctagcatcttctggacatccgcaaacgcattcttgccatttaaagtggcatgataatcattagcaaatgttcgtaatggcaagaaatagtctggcgataagaccaaaataaccaacgctggtagcaacgtaatcgtgccgttaatcaaaccaaaaccaaggaagaccgcgacaaccgcaatcgataaggtcgtgaagaaatccaaggcgaaagtcgataacatcgcaatcttgatgaccgccatcgtttgcttacgataaccttcactaacctgataaacgttgtcagcgtaccgtttgctcagtcctaactgcttcaaggtcggtaaaccgcgcagtgtatcaacgaagtgattagacatccgttgatagcccacgtactgcttatccgctttagcttgagcggcatagcccaaaataatcataaatagaataattaatggaaaaattgccagtagaaaaagggcctcacgccaacgcaaccacgcgatgtaaattaaaatgatccacgggatcaccatcatgtcgattactttaatcacaaccaacattaagtatgtctgaactttatcgatgccttcaagcgctgtcgtcaccacgttaccagtcccagtcttagccacataacttgggccgagccggtataacttctgcatcactttacgccgcaggtcacccgtcgtctgttcgactaacggatacatcacacgatttttaatgacgaccagtaactgccgtccgacccaagctaatgcgaaccatagcatgggctgactgatcgacgccaatgaatgcaagtgccacagtccaacaatcgccactgatagatagtaggcctgaaagacaatacaaataccctcgacgatggccagtaaccctaaaatcgtggctgctcggcgcatccctggtagtttaaataatgccggatcaaacacattcgatcactccctacttaaaatgaacggggtcgcaccctggcacttggggccaaggtcgcgaccccgttggtgctgttaaattaattgtaccaccgcaccagtgatactgtcgtcatctgcatttgaattacgatgccaaccgtttatagaagacccagtaactccaaataaagtagatcaacataatcggtaataccgataatgagattacagtcatcagatgcaacgtatatggtgaattagacgcatctttaatcagaatgctgtatgcagaattgttcgccaccatgacacgtgggaatagtccattgaacaggagcacgaccacgtcgatcagtgagagaccactgctaataaatgagagccattcatgatttccataaacaccccaagttgccaagaccgtcaaagccactaaggcgaccactaaaatcgtggttgagattggtttcttggtaaagaaatcggtgttaaagaacagcagaattgcgaagacaacttcaccggcaaacaggacccagtataacggtttggcccactgaagcgccccgttcacgcaacgtcccggtcgtcttcagacgaataaagtttaacccgtgcaaatagcagagtaacgttacggcaaccccaccaacgattgagaacaagttcacgtaatcggtgaagtgggcagtcatatcgccattggcattgattggcatccctttgaccaaagcagtaaacatcatcccaaataggaaggcagcaaagaaactacctagggctgcggcccattcccagaaattccggccggcgtcactttccatccggcttctaaattcaaatgagacccctcgcataatgagggccactagaatcaacaataagataagatagaatccggagaataaggaagcataccacattgggaacgacgcaaacatcgccccaccagcagtgatcaaccacacttcattggcatcccaatgtgggccaatcgtatgaatcacaacatcgcgctcagcgcgtgtttgggctaagctcttaatcgtcatcccaaccccgaagttcaaaaccttcaaggaagaagaaaccactaaatagaacgcccaccagaataaaccataagaattgtagattactcatgactgaacgcctccttaccataaggatcgtacggtgcgtcatcgctagcttgtaacaaatcatcaggtccttggtgtaaggcacgccgtgataagacgatcatgacaatgcctaagccactgaacaagcagaagtacacgatgttagagatcagcaacgaagcgacactaacatttggtgaaacggcatctgcaatcgtcagtaaaccataaacaacccatggataacgacctaattcagtaatcagccacccggccgtgtttgcggcgaatggtaagaacgtacagattcctagtacccacaggaaccagcgctgccgctcaatcagcgttgactttgcacggttgaagtatagaccgataatggcaatcagtgcgaagagcccaccagctaccgtcatgacccggaagctccagaaaagcgtatctttgttggcacgtagtagttcatgtccttaccaaatttcttgtcatacttggcatgaagttccttgttaagggtattttgtcccttcacattaccggacaacttatgatagcttaaaatatccaacacatacgggatttcaatcgaccagttggccttatggttcttagtatccatcccttcaataactgcccatgaagctggcgagccggaatccttatataagccttccgttgcggcaaacttcatcggttgttctttaatgatgtaacgcgtctgtaaatctcccattccaatcacaccgatggaagcaaccaggccaacgattaaactgaccttgatcgatttgcggaagaacgtgacgtttttctttttgagtaacgcaaacgccgccatcccagcaaccacaaatgagccggtaacaaacgccccaaacaacacatgtggtaattcataccagagctgttcgttcttgacgactgctgcaaagctcgtcatctctgtgcacgaccagtcttggtattgatcatgaaaccaactggattttgcatgaaactgttcgctgctaaaatccacatcgcggaaatcatcgtcccaatcgacgttagccagataaacgcacagtggagcttggcattaaaccgatcccaaccaaacatccataacccaataaacgtggattccataaagaaggcaactaacgcttcaatcgctagtggcgccccaaaaatgtcacccataaaccgtgaataatcagaccagttcatcccaaattggaattcttgtataatccctgtcacgacaccaacggcaaagctaagtaagaaaatgcggccccaaaattgtgccatgtgcttgtacatgatgtctttttgacaacatacaccgtttccatgatggcaacaaccaaggctaagccgattgataatggcacaaagaagaaatgaaacaccgtggtcatcgcgaactgaaagcgcgccaaggataaaatatcttaatccgagattcataatggtccccctttattaatttattccctacgaaagcggaaacactttattcacctttcataatagcaagtgataagtgaaatttcaatcaatctcaacttttattcccaaaatagtcaaagccgctaattttcaaggccactattagtacgcttattcgtttgtaagttcacattttgcaatctggcatctgctggtaaaatcacgcgtgactcccgcgaataactgagcttgtcgcatcataaaaatcaatcatcgtactcaatcagttaataaattagttcatacaataaacaactgatgccgttattaaaaaagtacctcatttaacaagtttagcccgcgaaaacgcaaacaagcctgggttgtcgtgctatattttaaaacgtgcaatagaataaaacgttacgaggagtaaatataatgaaaaggaattcacaacaatcaaccaccgttgatcattataaaatgttcaaagatggctaaaacattgggtttacgcggggattaccattgcggggctcggtagtacgttaatgctgacgactaacgccttagcagcaacggctacccccgttagtgccacgaccacttctgcggccaacgccccagctagcgttgccagtcaactcagccaagccgccggggcaacggtaaccgagtcaaccacgacaagtagcatgactactggtgaagacagtaataccacgtcaaataccgacagcagcgctaccactgacaccaatcaaattacgactagtactaacgctactgagactagcgcgactgaacaagccacaagtgcagcgtcagctaccgaccaagctagtgaggttgctaacagtgcgagtggcacagtaactagtcagacgaccagcgctactaattcgacggcagtcaataccataagtggtaacgaacaggccgctagctcagcgacgagtgacgctactcaagtcacggatatggtgacagccacgacgactaaatcaacgaccgattcagctattgattcaactgatgatacgagtaccaacaccaattcgaccgctgcggcaacgccaactagtgtggcgacgaccagcgcggctagtgccgcgacaagtgacagcggtcatggcttaatctacgaaaccaacgacacgactggcaatcaaaagagtacggtcaccattacacaaagtggcccttacagtgtgacctggaaaaagttactacctctgataagacggacaccaccacggtcacgttagatgccagtgatattgtggccgtcgttaatacgatcaaggacttagcaaatcaagcagcgaccccgtctgaaaagaacaattagcagcagccaaagccaaactgacgacaattcttgacgagttgaaagagctccccacagatatcgccagcacgatcgtgggtaatgtactctacccaatcgtcttcacgggaactggctcagaagccctatctaatttacgtactgaagaatgaaccagcaccgctatgacatctccaatacgtggaccggcctcgatccagtcgcttatgctgctgaccgggctgcggccgaagaatattacccgacaacggttacttggtgggataacgttaccaaagaaacctggaccccgcctgaatacaatgacccgacgcagtctgtccgtgcttactatattcaaaatggtgattccaccaagaccgtcatcatcggccaaggttggacggaacatgttgattggatcggctacgtttcaaagatttggtatgacatgggttataacgtcctcatgccgagtcaacgtgggcagttcctaagtgacggtgataacttaacgtttggttatcaggacaagtatgactggatgaattgggttaagatggtcgacgaacgcaatggcgccgacagtcaagtcgtcttttatgatcaatcattaggtgccgacaccgtgttagaagcagcctcagttcctggactttcaaaatccgttaaagcagttgtgtcggacgccgggtacgcaaccttaccagaactaggtagttcgctatacaacaaagccatcaccgccgtttcaaacgcacttcaatccattggtctgccagccatcacgagcccgcccttcttatcctatgataaaatcgtggccgcgatgaacgctcgtttgatcaaggaacaaggtttcagtgtcgatgacttatcagcaaccaatgcagctagcaaaatcactatcccgttactcttgatccacacgcaagacgacgccttcattccatatactcaatcattggaattagcggccgccaatcattctgccaaccaagaagtttggatcttaccagggactgtcggtggtcacgctgcggctaataacgcgatcctacaataccgccaacacttgttagctttcttaacaccattgctatccgtagcggatgctgaagatgaagcagttgatgttgatcaagtaacggataatcgtaatcaggggagcggctgacaacggtacaacgaccgattccacagcacaggacaatgttaccgatgaaacgacggctgacgaggccatcagcgaccatcaaactatcgtggataacacgaccactgacactaccaacataactagtgatacaacaccagacacgaccaatcatgcgaaacctaatgatgattcaacgactagttacgttgacttgaacgacacggataacgcagtggataatgattccgacacggcggttgacgcaacacgtgcgacgaccactgtgaaccagacaagcactatcgatcagagcagcgtgattaagggccaagtcagtgattcaattatggtcagttcaaacgccacgactaacactgactggttagttaatcacgatgacagcggttcggccgtcacggctagtctgcttcaagattatagtgaccaggaagcaagtgtgacgacgccagccacggtatctgccacaacaactaatactgacagtgccgaacttagttgccgtctcctcaccagcatccaaagccacaactgagctcccgcagaccgacgaaacaactcagtcatggctcgcaacgctgggtaccagtctcttagccctagcaacggggatttgggcccaagttcggcgacgttttaattagtgaacttttacctgttacgtccactggtgtgttatccttaataaaactatcgtgcgaaaagaggcatcatcatggatattggaacacaagtgacgttcattttggaaggccagaattataccgggaccattgcgaaaagttacactaattcgtatttaatcacctttacaagtcctgatccagccatcgttgataagtatcacaacaaagtaattattagtcagaaacaagttcaagccgttaaatagcgatttaaaacagccacccttgaaattcaggagatttcaagggtggctgttttaaatttgaattgattcaagctagctgtcactttagcgacttattttttttaaaacgtagtaatggtgtcccgatcagtggtgtgagaattccagctaaaatcgcttccggaatcccattcgaggccacgatcgttaacaagtacggcattagtttgctcaaattaacttgataaaagccggctgcttgatgactatagagtagcccaatcaaacctaagactagaatcgtgttcgttaatgccccggccacgcccgccagcgtcatccccaacactttttgatgccgcttctgaaaccaaataaagacccaaccggctatcaaaccgacgagaatccggggtatcaccgaaatcaatggattggtaaatacgattggtgctaagggactcgtcggtgcgacgaacgcccgtatccacgcaataattccccatgcgcccccaataattgccccatcacgcggtcccaagaccacggcggccaggataaccgtcacgtgaattgtcgtaatactcaatcctggtaatggaatgtacccaaaaaacggaaacacaatattctgaatgatcacgattgccattagtaccgctaatacactgatatgataggcgtttgaacgtctctgcatcatcagccacctcaactctctttaccttatgaattatgcgcttaattatagcatatcccaaagcttagtagccgcgaaaagaatgggtgcttacccgccccggtaagcacccactattaattacgattttgattctttggcacgtaaccccgctcgaatacgggagtgccgataactataggcaaagtaaatcacgatgccaataaccagccaaataccaaacatatgccacgtaaatgccacgcaaattaagcatcaggtagacacatgcgaggaacgagacaactggtaacactggataaaatggtactttaaatgaactattgatttgttgtagcgtttcgtgtcgacgcaggaagacaacaccgatagacaccatagcgaatgcaaatagcgttccaatattgactaactccgcaattttttatctaatggaatcacagccgaaaatacactggcaataatgccaaaaatccaagtactcttaactggcactttggtatggggactgaccgtccgaaagactttcggtaacaacccatcccggctaatcgcaaacagtaaccgggtcccaccatataacatgacaatcaaaacggtcgtcataccgacaacggcacccagtgacacaatccccgccgcccagttttgatgaatgacggctaaggcatacgccacgggatcacccacgttaagcttactgtaatgcacgaccccgaccagaacggcggccattgccacgtataaaatcgatgctacgactaacgaaccgacaattccgattggcatattacgcttaggatttttcacttcttctgaagcagtcgacaccgcatcaaacccaatatacgcgtagaatgctaacgacgcgcctttgaccagtccgctaacaccatggggcatgaacggatgataattggcggagtttcacaaagaaaattgccacgccaatgaaaagaacaatcactagaatcttaacgattaccataattgaattgacccgtgttgactcttgtagcccaccgaccaataacagtgagacggccaaaaccacgacaaaagcaattaagttgaatccagcaccactgacaccggcagtaccagctgcggcggtcagaaatgttggtagttttaggccaaagccgctcattaaattctgaaagtacgatgaccaacttaccgccaccgaagataccgcgaataaatattctgagatcagagaccaaccaagaatccacgctaagaattccccaaaaacggtataaacgtaagtataggcactccccgccaagggaatggttgaagaaaattcagcgtaacataatgcggccaacgaacacacgaccgcagcaatcacaaatgagagcatggcagccggaccggcatacttagcggcgataattccgggtgtgataaaaatcccagaacccacgattgcgccaacacccatcatggttaaactaaatgcgctcaacgtcttttcgaggccacccttattaaaattagctggattgactgatttttaaccagcaatcgttgtgatgctttcatccggtacgcctcctaatcaaaatcttaataatgcaacgttgttaattctattaatttttgtgcaattagtcaagtaaatctaacaatttcaatcaattcctaattgaatcctttcaagacagcgctttacagcattagttattttaaacaaatttattaataatccataagattcactaattttaatttaaccgcattattatgggtcacgacttaaccaaattttgtcaaccgtcgctgaaaaccgggctgaccagtccacagtcatacgtcccgacttaaatttgtttctatcatattcatctgcttaaacgtaatcgccacaagcttgtatcttcaagcactcctttcgcaaaaaaatttaaggtcggtcagctgaaagaattcgactgatcgaccttaattttgacctttaacatattttaatcgggttcaactcaagcagttttgatcaaaaaagaagcattccgtctctctcaaccggaatgcttctaaataaactttaaatatattggatcaaggtcatcaagactggcacaaccacgatgaacaacacggtactcgttgtcacgatgttagtggcgtattccacgtcaccatgtgcttcgttagccaagattggtaacacggctagcattggcgttgctgattgaacgatcaaggtttgcgatgctaaggttgggaaacttgcaccgagattgccagcaaccatcaagacaagaatcatgacgattggtgacaagatgaaacggccaaccaacgcaacgaccgtatcacggtcaaagcgaatactcttcagaccagcgtcggccaacacgatcccgatgtagatcaaggaaagtggcgttaccaagttcccaacgtggtaaagtcaacgttgaactaacgaatgataccttcatgattgggatatttagtagtaagaaaattaacgcaactaagaaaccaaccaatggcattggaataactttcttccagtcgatcttgttatgcgtcttttccttggacttcgtcgggtcgtcgtttgaaatcaagaagaccccgaatgcccacgtcgaaacggtgttcacaatatagtaaacaaggaaatacgtcatactcttgtcaccgaacaacgcaatgttcaaaggtaacccaatgaaaatcgtgttggcgttgacgatcgcattgatgaaaatccccttacgacccggacggacccgcatcaccttaactagcgcaaaggcaatcaagtagccaataatcacggctagaaaggcgtaagccaagtaacccgcaaatgatcctaactgcccacgagttagtcggctcagcacagatacgaaaatcgatgctggcaaagcgatatttttgataaatttggaatattgttccagcaaacttatcatcaaaccaacttttgctcgtcgtaggacgaaacctaatatcatgatcaaaacgacaactaagacgctttgaattgaattccataaaactcccatgtgctcttataccctcttacaattctcttattttaccgacactatttgctgatggcccggtattctgggacccacttcatatcagcaaccgcttgtttagcatctgcaattggttctttgttgagcttctgatcgataacactttgtgccacgacttcagctaatttttgtgaaaattcagtaattttcgcaactggtggcaatactgcggcacccggcttcgacgtatcaacgattccacctaatgcgtggcgggctgctgacaaggtctcagcgttcagcaccttggctgttgaagcaatcaaaccaaatcctaaaccagggtacatcaaggcgttgtttccttgaccgatttggtaagtgacacctttgtattcaacatcatcagaagctggaatcccagtcgcaactaaggcccggccatccgtccatttgattaaatcttccgctttagcttctgctaacttggttgggttagaaagtgggaagatgattggccgttccgtgtgcgccgccatttccttgataatgctttcagtaaaggtaccaggctgagtcgatgtcccaatcataacggttgggtgaacggctttaacaacggcttccaagttggttaattcgtcagcgttgctaaattcactccgtttgcgcgtgaaggctttttgggctggggttaaaccttccgtgtcgtcaaatagtaaaccttgcttatcaacagcgtagaagtgttgcttagcttcttcttctgttaaaccagcttgcatcaattcatccaagatttggttggcaattcccataccggccgttccggcaccaaatgataagattttttggtccttgatgctttcctttgaaatgttcaatgcacctaagataccagctaaaaaacaaccatcccggttccttggatatcatcgttaaaggttgcgatttgatccttgtacttgtccaagattacttgcgcattgtcgcgaccgaaatcttcaaagtgtaacaatgaatcggggaataattgttgttcagcagcaacgaacttgtcgatcacatcatagtattgttcgccggaaacacgcttgtgccggttaccaagatacaatggatcatctaataatttctggttgtttgttccagcatcgatgctaactggcagtacttgtgatgggtcaatgccggcagcggcggtgtaaaccattaatttaccaatggcaatatcaacaccgttaacaccccagtcacccataccaagaataccttcagcatccgtaacaacgactaaccgaatatcacggccgtccgctgcattcttcaaagttgcttcaatatcttcaggtgcatctacggaaacaaaggccgcattttgtgggtccaagaacaattcattatattgttcaatggaatcggcaacgacgggatcataaacgattggcataaattcaaccacgtgttcatccatcaaatggaagaatagtgtccggttttcgttaaagagattcattaagaaaatccgttgttccaaacgactaggcttgctcttgaattgggcataagcttgcgtcgcctgttcatcaattgtttgaaccttgcttggtaacgtccccgtcaagccaagtgcttgacgttcctctttggtaaaggcagtgcctttatttaagaatgggttatttaaaatttcacttgcagtttttgtcattactgcggcctcctaattaatttacattttcatcaattttcattgctaggaaaaacgtcctatcaatttacaagtaatactgtaacgccagtaaaatgttatagtcaaaactatgatatgatataaatatattaaataaggtcgctacaaaagctgatttagaaaggaataaaaatgaacacaaaagacttagaccttatttcgatgaattaatttctcaaaaaaatttttcaaaagttgcgaaaacattcggtgtgagccaaccaactgtgaccaccgcaatcaaacgcctggagtctgaattcggggcaccactcgtgattcgtgaccgtgttaaaaatacgttgcacgtcactgctagtggggcgcaactcgctgaacacgctaaaatcgttttacatgagttacgcctcgcccaccaagaaatcgacaatctatcccaaaatcgactgattttaggattaccgccaattattgaaaaccattattttccaaaaatcggtgcccggttggccgcggaagggctattagccggtctcgaaaccattgagggggctcgatctggctacgtaacgcggtgcgggacggtcgcgttgacatgaccccgcttggttcggtggagccgctcgcttaccaaacgttgattgccgaagaatttgaccgtcagcccttctgtatctacgtgtccaagcaactatccgttagcacaacgtaaacgggtctactttaacgaactacgacgtgaaaaatttgttttctttaatagtaatttcatccataatacggccttcaacaaactcacgcgccggaatcactttcgccccaacatcgtctttcgttccaacgatacccacgttttaatgaaattgattggtgaaaatgtcggcatcggtttctttaccaaaatcgtcgatcactaccgtactgacgtcgtacgactggacttgatggacattgaacccctgaattcatcacaagcatcgtctaccgaacaacccatattctgacccccgtgcagcaacagctactgaccattttgcacgaaacattagcggttgacactgatcagaccgattaagcaaaactgcaccacccttacagaatagtctgtgagggtggtgcagttttcgtaatcaagacaaattgcgatatatccaaatgaaacaatcgtgaagacacgtcaatctcaaagtaaaaagttgaaccactcaaggaatcgtgctgttcacttagacagatggctcagtcgcgacgtttaaatcttcattttaagtaattgatcaataaaccgttgttcatcagtggttggtaagtacccggcccgtgtgaccaccgagatattgaagctgaccggcaattgatctttgatctccaaacatacgacgccatcatccgctttaaccacatcacgaaccagtaagctaatgcccaagttggctttaactaaggctttgacccatgagatatcgggggtccggtagataacttctggatgtaccccggcaaagtcacaataggctcggaaggcttgtgggtgcacgtatttgccatccaatccaatgaactgtgcctgaccgagattcttaaaactaacggcggcttgtttcgccaaactattttgaggactcacgataatactgaatggccgtgcccctaagtgaaccgcacgaactgtcggcaaatcaaatggtaagataggaccctaataacgcgatgttgatctcaccatgcactaacttacgcaatagctcatctgagcccgtttccgttatttttaactgttgcagtaacccgttctgaagtaacttttccgcaatttgagggaaatataaagtgccaataattggtggtaagccaaaacgaatatcagtctgtaacgtactctgaatttcgcgatgagcaagttgcaaactggcctggatctggcgtgcattcttgtaaagcagctgaccggcccgggtaatatttgtctgttgatggcgacggtcttgaatcaccagtttgactgcaaactctttttccaaccgatgaattgcttgagtcactgccggttgtgagaccgcaaactgcttggcgaccatcgtataattttggcaatcaactaacgcccgaaaataatctaaatcacgtgtattcatccgcgctcaccaaattccttcatgtacatcgccgcaatcttttgctgtagctcagccactgaatgccgccgtgaacgcgcgcaatccttggcttcgcggtgacataataagcaacgacgcttcggcagtcccaaatccgtccgcgacagcgcgctgtgaacccgcttgtaagatatcaatatcatataagcgacctaacggatcgtgttcttcaaacgcgaccgccagccgtttgctagtcgcaaagtcagtcgtcagaatcaagaaccgctcattacccgccagatgattccaatcagctgccaccgtgtatgtcgacaactcagcttcaaaccgctggacaccggccaaaaacaaccgtcgtagtgcagcgttattcttaatcggtcccggaatattcaacttgatcgccgcaatcgtggcccggggttagtcgctgtcaactgttgctgatacgcgacccgttgatcacgggctgctagcattgccgtgattgtttgcggttcaccggttgtaaaaatcgtcgccatgcttgtcactttcttcctatatggcgtttgttatatttccagcttaaccgaaattagtcgatttttaaactaatttctttggtctctaactacagcccaaatcaaaaatagcccacgcaccgattactcaagcgcatggactattgatttgggttagtcaaaataacttattgtaaatatttgaacatttgttgtccggcttgacggccaaagatcaccgtttcagcgattgagttaccaccaatccggttattgccgtggagaccgccgaccacttcaccggctgcaaacaggccggcaatcggtcgttcgtcctgattcaacacttgggttgctggattaatggcaatcccacccatcgtgtagtgaacagctggcgcaatgtgaattgagtagaacggtcccgccgcaatatcgcgatccatcccagtcgtccggttaaaggccgcatcattatggttagcgactgcctgattccagtcagccaccgtctgtttaagcgtcgcagcgtctaagcctgtcgtcgccagtcgccagtgcttccaagtcagtcccagtctttaccaggccaatgtgatcatagaattcaaccgctttgacccggtcacgaataccgcggtcaaagatcaagtaggcaccagtaccacccagttggtcgatagcggccgtcacgttcttacgcgtgtcgagttcattgacgaaacgagcccctggttatcgaccaaaatcgcaccttcgccccgaaccgcttcaccgattaaataagcatgatctgtatcttgttggaccgtcggatgaacttggacttggtccatatcaaccaacttagccccaatagcttgtgccaacagaatcccatctccagtcgcgcccggctgattggtcgtctgatagtttttaagatcatcacgatactggcctaacaaggtcttattcgcaccgaagccaccggttgctaacaagacggctccagccgtaatcgtgacagctccatctggggttgttgccttgacgccactaatttttgccggcttcgacgagtagttcatcgactttgacatctgttaagagtggtaactggtcagccgccacttgtttcaacaactcagtgactaagaaaccaccaatgggagccatggaacttggccgatgagtccgcatcacactcatcccaccagtaatcgtcaaatcatccaacttaatgccgtggtctgctaaccagtcaattgcgagcgcactgtgttccgtgaagaatttcaacagtgcttggttattcataccgccaccacctttaagggtttcgccgtagaaatcgccaaaactatcaacaatatggtgatgcaattggacgttcgtctccgccgcattcataccggatgaagcccgggtggtgttaccaccgattttcggcatttttctaaaataaccgggttcaggcccaattcatgtgcctggattgccgcagtcaaacccgcgcccccgatccaataatcactacgtcatagttcggtttttagatccgctaaggcggttggtgtaaatgtaaacttttcagccattgattgccacttctcctctcaattcgtccggggtattccccaggatggaaccaaaatctcatttattattgtcgttaactggacacgggccaccattccaagtctaggaacaatgacccgtgccaccttgatccacgttaacggttcaacgccgatcaatacttattttagcttaatcatcaatattcgtcatatccagtggaaccatccattcatcgaattgttccgcggttactttgccagacttgatggctgcttcacgcaatgtcgtccccgctttttcagctgcttgagcaatcatcgcactatcatgatagccaatatgtggtgacaatgccgtaaccgtcatcaaggaactgtcgactaactctgccatccggtcttggttgaccgtcaaaccagcaatcattcggtcagtgaagccggtaatcgttccagctaacaattcagcagattcaaggattaggcatcaatcaaaacggtcttgtaaacgttcatttcaaaattaccttggctagaagctaaatcgacgaccacgtcattccccataactcgtaccgctgccatagtgatggcttcagcttgggttgggttaactttcccaggcatgattgatgagccgggttcgttagccggaatgtttaattcgtcataaccggcccgtggaccgcttgccaagaaccgcacatcattggcaatcttcatcaaatcggctgctagggtcttgatggccccgtgaaccacgtttaagccagaatgatgggccaaaccatagaacttattggaatcagccgtaaattcaatcccatacaatttgctcatcgccgcagcaatattttcagcaaaatgaggggcagcatttagaccagtcccaacggcggtcccacccattgcaagctcgcctaacgttggattcaactgttttaagtaggcaatatcatgttcaatcgcactggcccaaccactcacttcttggccaaaagttaatggcgttgcatcttgaagatgggtccggccgatctttactacccgccagtacttcttttgtttgatcttcaattccgctaataagtgttccgctgcggcaatcagcttatccacggcaactgcggccgtaatgttcatcgccgttgggaagatatcgttagagctttgaccatggttaacatcgtcgttcggcaagatttcaatatcaggattgatcttaccagccatgtgtgcgaccacttcattaacgttcatattcgtttgcgtccccgaaccagtttggtaaacaaccagcggaaagtccttacgcaaatcttcatcgtcgagcgctaataacttatcaatggcagccacgattaaatcagctttttcagcagtcattgcttcaacttctttattcgcaatcgctgcggcccgcttaatttgaagtaatgcccgaatcatttccaacggcatcttcgtaccagtcggaaaaggttatggcgactccgttctgtctgagcaccccataaggcgtttcgcaggaattttaacttcgcctaaagtatctgattcaactcgatattctgtcatgttgataacctccaattaatgtgttggtaagcgcttactaagtgtgtgaaaaaaataacattcagtttataatcctagtttagcgcccccatatagctatagtcaaactcagttttagctataagtattagttatgaggtttatgtatcagtatattagcatacaaagattgcttagaatgagttctagataaaaatgtttattttttcacatgttcttatttattcctcttgcttaattttactcataattgtcactttttcttatttgtagacctaaatataccaaaccacaaaatatcgagtcatagttgaaaagagatgaaatcaggcaaatcaaaagaacgacgtatggttaactagtaaaactttttatcaaattcggttgcaatcgagtaggaggtacaattgattatttcaattaccgacctctcacaccaccgtacgtacggttccgtatacggcggttcaataatttaagcactctgtatttgctggagtgtcttggacaggtttattagtccaagacgctccagcttttgatttgtatacgtataggttagtgttttattatgggcaattcgccaatatcccttgcgggtattggcattagtcttggcctgttccggtgtcattcctagcttaattagctcacgatatcgggttttgattttcttccaccgtttccatatcaactgtctaatcctacttcgcaaccattggtccagttgttgaataaacgtcttcatcttgccaatcccatagtactgtagccatcctcgcattttctgtttaattttcttcatcaacattaaccaactaattccacgacttcgcccagtcattatcttaagggctgattcgctgtttcacgaccttgtgcggtcgtgcatatgccccattacgaggtctacaccgagcgtaaatcctagaaactttagtcggagtggtgagccaaccgtcgttttatgacagttaattgttagtttcaacttaatttcaagaaagattgtgacattacgtaagactcgttctcccgctcgcttacttctgacataaatattacagtcatcggcatagcgcacaaatcggtggccccgctgggtcaatagcttgtccaactcgttgagataaatattggccagtagcggcgacaggttcccaccttgtggtgttcccttcgtcgtctttcgaaacagctcgccattcatgaccccgcttgttaggaagcgccgaattaggtggagtagccatggatcagttactcgttgtttgatgaagttcattagtaagtcgtggttaaccgtatcaaagtatgcctttaaatcgagggctaccacatagtggtagccttgattgtagagttcggtgacactttgaatcgcgtcatgcgcactcccgacctggtcggaatccatagctattgtcggaaaatacctgttcgtatatcggcgaaagcacctgtaccacagcttgttggatcatacgatcaacaactgtaggtactcccagttttctggttgagccatcgagttttggtatctctacccgtctgactggttgcggccgatatattccattacgtaaactctctaggagttcttcccggttcttgtaaatatattcggccagttggtcaacggtcatgccgtcaattccagctacgcccttattcctccgaacacgcttaaacgctaggttcagattactacttgcaaggaaggacccggtctacaaattgaatgccatcctgcgccgtactttcaccgttagtagtactatgcgccccaagatactctttgtcttccagactattcatcccttggcggtcagcttgttctgttttctgcaatcttcgcactaccatatcggtgagaattattattgttcagtccttcatctgccatgacggcagattactatgacctcggctgactagtttactcctgtaaacccatatcggcgtccttgttgggagcttatccgacaggcctcccgggtaagaatgatagctttcataccatgcaaccgttggctttactaacttcgacttcaagtagtgtaggacttcagtttgtgaagcaacttcatccagtctaatcagccttgtagccacttcttgtacatcggttcggtattttgtcttaggcttccttcagactccgtctcacggcgaacgcccttgccctcaactcgtggttccgactactacggcccacagcggacttacaccgcctagttatcacccatgccgggcgcacttcaaaaaagagaggctgtgacataactagcctctgtataagcaaatgaggctgtgacataactagcctctgtataagcaaatgggacgagaaaccgaattttggtttctcgtcccatttgcttacgcctttgatttttaaagttggtccctaccgtgaccagtttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgaccagtttctggagctgaaagtaattctcgttgtttcgatttgaaatattcccaattttcgttcacggaaatccttttaagatatccttttggtgttagtgccgcggcaattagttgatgattttcatcatacttttcggcaatgtattctttaaagtcacgggtaaaaccatacttatcagtccgtcgacgataagcattaaaattaaaccggacgtttttcggattgataaaataatcatctttttcatgatagtaccagttcataaccttacggtcatcactttgccattttcgactattctctttaagcattgtgccgtagggaatcaaaagcggtatgctgaccgaattcatcttccaagtaccgataattactttcggaaccgtatccggcatcggtaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcgggttttaattgaccgttttgcatcggatcttccttgacccgcataaaggtggcatcgtgatccgtcttagagtagctgttacgctgaccatagattgcttgctgtgcttggtgttcacgcattttatcacgtcgtttatccaacttacgtttttgtgatttaacagtccggcgttgctgtttggctgggttcggggaaacacgcttagttgcttccacggtttcattaaggaccactaagtgatcctcaaccttgctaatcatgatatccaatagttcgggagtcagctctgagtctcccgccggaatttcaccgacaattttagcttcatgaagctcgcctaacaggtcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagctatcggttgtcaaagtggccagttcatcagaaattctaaagcgacaaatcgtccggtaggacggaatttggtcggcaattaaccacccagctggcttgttttcacgggcaaactgttcaattttacgactgctgaaaatgccatagcagtatgctaaaaggaccagttttaacatggcaccgaggttatattcccgcggacggccaaactggtaatcatattttagttttaaactctcaacaagttggttgatgtaacgagcaggatgatgctcttctggttggtaatccaaggcgatactcaaagtggtttgattcatgttataataatcttgcatattaggaatgtcctttcgaggataatttcgtagagtatcgggtgcgaccgatgctcttttttattttctattatatcaaaaacaggtctggaaaaatccgaagatttttccagacctgttttgtttctagagacttatgtcacagcctcttctagatataacttcatcgacactggttgacagaagccccttattgatgctagccatggcatttcagaaaagcacaatgcctctttataaatccattgaaaatgccgcgtcagacactaatcctggtattttcttagcgattcaaccatagtccaagtactaaaagaacaatcatgatacctaaaattttggcgtggttccaatacttaaacagcaagtcaataattgcaatcacaacaaatacaatcagcaccgacataaaatacaaccaaacattgccattaacactaactgtcacaacaaaaagccaataacggctagccatggtaaatatttatcaataaatagcttaaaatttgggtattgatccataattaatccaccctaaccaccttatatttctttacaaacgactgaatacgtgaagcctttttacgaatgtgtttcctagatttattcgtataaatatgaataactgttttatattgtactacatacttgttagcgcgcttatacgcccacgcagttaaataagtatttctgcagaaaatagctcccaaaaaatgtacccccgaacatccaaattgcttgtccgccatatttggacgcaagcgcctgtactacgtaagtcatgattgctgcagacccagacttctttaacttttttgttattttaacagtttttttgaattttttcctaagtttccattttcccttaggcttaggtgcaactctcttatacttggctgcctgtgcatgtatttcacctatactttctgaaaaaccatcaaaacttgaaaatacactaaatgagtttgaaagtatctcagatacttctgaagttaaaaaaatgaaatctattttgaaaaaggctcgacagctggaagaaaaatcgacgttacgctatatccattatataatttgtgttttagatgctcttatacacgttgatacgtacaattgcgatcaacttactaaccttgtcaaacctgtctggaacgaattgtctacggtaagtgtctggaatcatacagacctttttattattaataatttactatatatttttgacttccaaactgcactaagaattgggaaaaaattattactaaacttaaccagtatggagataataatgttttactacaaaatgctatttattctaatttagcattcattaacatgaccaactccaatgcattcggtaaaagcataacaattaactatttacaaaaagtatcgagttaaccaaacacgctcaccggtatgatttactattattgagtaagatccgtttagcaaatggtattgcaacaatacgaaaaagcaaaaaaatgtgctcaatacttacgcgcatgggggctaatgacattgtcaatctggtctaccaagattttcctattcttgtaacctaaattcactaatactatcacttataacttccccgatttattcacaaaaataaatttagcgtagtacaactgaatttaagttaaaacttgggattaaccgtcttagtttattatttttccccataaacctcgatgcgaacaagcgccacacatgtcgttaatgacgaatttacaattgaagtgcaacaagtaagaaaaaaaaataaaaaagaactcatagcctgagtcctataaaatgaagtcaccacaacaatcatctaaaggagatcctaggctatgagtccgtacaaccatcttaccttaaaagaccgagaatgcatactgttgggcgtcactttaaacgatacctatcaagttattgcggagaaaattgggtgttccaaagccaccgtatcgcgcgaaatcaagcgcaatggtggtcgtaaggcatactcggccgtcaaagcccaagagaactatcagggacggcggctaaaaagccgacgtcctaggcttctaactgatttgaagttacgggattttgttcttcactgtattgttcaacgtcagtggtccccggaacaaatttccggtcgtttagtccacgaaaacagtgaatggcatgtcagttataacaccatttatcgtgggattgaacgtgataatttaggcatcaaacgtaagaatcacgaggctcatggctttgcccgtaagctccgtcaccgtggtaaaacccgaaaggtcaagggaaccattaaggaacgtcggggacgatttaacgacgtcccttccgttcatgaacgacctgtttcatgtgagaatcgaagctggtttggtcattgggaaagtgataccgttcgcggtaaaaccgggcgttcggccctagtaaccttggtggaccgcaaatctctggggtatttattatctcagcgggttcccaaagtaaacgccaagaacgtcacacaagtgatgattgacctcttgcataccgtgacgcccaaacgagttcggacgcttgcgccggatcgtggaactgaattcgcgaggataccgcgaagttagtcaagagctaagtatcccagtctattttccagatcctcatgcgcctcagcaacgggggaaccaatgagaataccaacggacttatccgtgagtatttccccaaaggaaccgacctagaccaactgactgatcaagatatcgacaagtttgtcagggatttaaatcaccgaccacgtaaggtcttaggctggaagagtccatttgaagttttcttcgggacaaagttgcgcttgatttgacaattcgtcatacaaaaaatgacctagctagcaatttgccaagcaaggtcatttttgtcatcagtatactttagtccttcaccgctttaatcgtatcaataatcgtgccatcatcccggcgatattcaatcaaggcaacggtgcgatctgtaaattcaagtggttggggttggccgactttcttttcggctaattgttgtaattcttcaatcgtatagaccggcacacctgggacatgactgagtgctttaactaggtcttgacgccggggttgattgcaatcccgtattccgtcacaaccacgtcaatggagtccccggcgttacaacggttgttacttctggcacaatcgtcgctaaccgaccacggacaagtggtgcagagataatggtcagtttggccgtagccgcgtcttgatgtccaccaatggcgccacgaatcacgccatccgaaccggacatgacgttgacattgaagtgcgtatcaatttccaacgcactcagaatggcaacatccaattgatcaaccatcgctcctttattatcagggtcagcgtaccatgatgcgtcaatttcttgttgattaggattggcgtgcatcgatgctgccgcccctcattgtcaaagtcttgaacatccatgactttatcaactaacccttcttcgagcaaatcagtggttggtttcgtaataccaccaagtgcaaacgatgctttgatttgattatcgagcattgcttgccgcaagtaccgagtgacagccaacgcagcaccgccggaaccagtttggaatgagaagccgtttttaaagtatggtgagttcacgatcacatcattaacggtctgggcaatcttcaattcctttgggtccttggtgaagcgcgtcgcacctgaaccaatcttgtcagggtcaccaacttggtcgacttgcacgacgtaatcgacttgtgtctgtttaattgaggccggtgtatttggataagccacaatattatcggtcaataagacaacttggttggcgtattgcgcatccatcagggcgtaacctaaggaaccaaagactgctttaccagccatcccgttcgcatttcctagtcggtcagcattcggcacaccctgtagaaaggcgacatcaattttaatatcaccatgttcaatggcccgggcccgattaccatgagaacggaagattacggggttctttaaaccaccgtgtgaaacgaagtccccaagagagccccgcatccccgagctagtaatattcgtaatcgttccggccttaattgcttcgatcaccatatcgttcatcacgcacgttaaggaggatggcgccaaggtcaaatctttaataccggcatcaataatggcccgcatcacttgattgaagacgaaatccccattacgaaaatggtggtgaaatgaaatcgtcataccatctttgacagtggcttttaccacgtcagcaacggaatcaacgactttgttgtcccctgttgaaacgtgaactttgggggccacccgttgaatttcaggatgtccgatttcagttgactcaaaaccttggtaatttaacttcgtcattaattctgctggtaattcgcggtctacactatttttcaatgtaattgccctcctcgtcgagtaagttggaaactttggctaagctcatcacacgttgagcccgcaaaacaacgggccggtctaccatttggccattcatggaaataacaccagaacccttgatccgggcttcctcaatcgcggcgatgactttttgggccttaataacttcatccttggttggttcatagactgaattgaccattgcaatctgtcgagggttgaccaatgatttaccgtcaaatcctaattgatgaatatgccgcgtctcacggtagaagccatcgggatcggccatgtttgtaaagaccgtatcgaacgcggcgattccagcggcacgagcagcatgaagcaccatgttacgggcaaattccagttccgcgccatcaggataacggtgggtcttcatgtccgtcgtataatcttctgctgacaaggcgatcccaatcattcgatccgaggctgccgcgattgccggggcattaagcacgcccttagcgctttcaattgcagccatcaaatgagtcgtgccaactggtatcttaaattcagcttcagctgccgtgacatccttttccaacgtttggatcatggtagccgattcgacttttggcaaacggataacatcaatgccagccttgaccattgctttgacatcatcagcgtaatacttggtatccaaaccattgattcgaacgaccaattcagcgttgccataatcttgcgtttttaacgcttcgtaaaccagcacccgggccgcatccttttcagccattgagacggcatcttccaagtcaaacatgatcgagtccgcaccgtaaatcccggcatcctttaccatggctggattattaccaggtacaaacatcattgtccgccgtaagcgttcttcattttcagccattataatacctcccatgctggtgtcgtggtttctaacgcccgttgtgctgccgtaatggtccgcgctttaatgacgcagtccaacgccccttttaatcaacagcgcgcaccttcacattatcgatattcaattgttgaagcgtcgtcgtgatcacgtgctttatttgtgccccgaactgtttgataacatctgattcaaggtcgatttgaatgccgttgtctcccgccattaacataatttgaatatcagatgattccaaggttccggcgactgccgttgtcttaatttccatcaattttcattcctttctgaattcgcgcttgtaatgttgttaggttattttttataaactgggccgttgttgccggtaccagttggtttaactcagttaagttgccgctttgaatccgttgccgaacagtccgcgccgaaattggttgattagccaccgtcgttcgcgatatcactcgtacagcaactgccggtggtaattcacgctgcaaaactcggttataaatcgcagtcgtccgcgacgtcggttcactaccaacgaaccgggtcgtaatgtgcagtgctggtgcaagttgctgcttaaagatccgggcgtccaacgtcgtctgcgcctcaattgcgctcgccgctgaatccaagaagtaggctggaaaggtcgctgcactcacgagatagtcccgcccgctgacgacccgaacgttggccaagtcggctgttccttgttgaaccagcttaacgcgctcggccgtacggaatagactcgcatctgtcgcaacgacgaagacgtaaactaaatcactgaccgccgcggcttgttccactaaatagcggtgtccccgcgtaaacgggttcgcattcatgacaatcgcgctgacacgctgttgtgcttggttgggaatcatcggcaactgtttgacaaaatccgtcatatccggtgcgccgttttctaatacggccgcttcatccgaatgagctaattctttaaagcctacgtgttgaaaactcgctgaatacttggccttggtaaataccatcatatgaaagatctgtgcttgaaacagccgattgaccagtgcactcacgatttgattaaaccgggcccccggctgactattcttattacagacacccacatatttaagcacgttgccagctaacgatccggtcccaacaagttggccatcctcgatcaatcctaaggtcacatcaatatgttcaacctcttgcgggctaaaattagtaatccctaatgacgttaagaattgttgccactgggcatgctcgtgcggattatttaattgcatttcaacaacttgcgctgccatcagacaacctcctatgattaatgctgtgcttgcgcgtacgctgcaacggccgccgtcacgttcggtaccacttgtgaatcaaagacgctcggcacaatcgtcgtcgcagttgggttcgacacggtcttagccaaagcctgagccacttggatctgcaacgcattatcaacttgcttgaccccatttgtgagtaagcccttgaagagccccgggaaagccagaatattattgacctggtttggatactggctagaaccctgttgcaatgactgtggccccagccttctcagctactgctggattgatttctggcactggattagcgagtgcaaagacgattggatcatgattcatcaagtggacggcccctgctgataagacgttggcgtctgacaagccaatgaagacgtcctggtcggccatgaccttcgccagtggttgcccctttagttgtgcaggtgttcccaactgtttggcaagattccgttgatactggttgtaccgctgatcatccgctgtaacgaccccgtaaacatcgaccaaggtcagttgtttgacaccgaccgctgctaataaccgagctgtagctaacccggatgcgccgacgccgttgacaacgatgcgcatctgccgtaaggacttaccgactacgtgagcggcattgatcagtcccgccaacacgacaattgcggtgccttcctgatcgtcatgataaaccggaatatcaagctcatctttcaaggccgcttctagtttcaaaacacttaggcgccgtaatatcttccagatgaatgcccgcaaatgagagcgacatgtttttgattgtcgccaccattgctggcacgctgacctgatttaacgccagcggaatcgcattaatcccagcgaggttcttgtataggagtgccttaccttctacgaccggcaaaccacccgcgggaccaatattgccgaggcccagtactgctgacccatccgtgatcaacgctactaatttaccactcatcgtgtattttgcctttaattccggatgcgccgcaatcagcttgaaatcaccgcaacaccaggtgtatatgctttacctaaatcagccttatcggtcactgcaaggtctgaatgaatgtccaaaaccccgtatgggcggcgtgcaactttaaaatctcatcttgttctaccatcaatatctgccttctcttctcaaaataataccgttcactttgttatccccagtgtacgaccattttttaaaaatgaatcaaattcagattggatttttataatttttaaaaagtcagcttttctggtataataaacttaaaatattataaacgagttttaaaattttaaatcttaggttgataaagaggtcatcgatatggacgatatgaatcatcgccgcctgttgattggaattgcacatgattattacttatccaaaatcaacatcgctgaaatttcaaagaaataccaagtcagtcgttatctaatttcaaaatacttagacgaagccatggcaaccggcctagtcaaaattaacattaacacccccatcgaacgaaatagtgagctggaggctaaatttaagcatcgttttccaattgaacatatttatattatcaaagacgcggataccacgagtgacgatgaacgccacgtaatcgagtttgccgccgaaacaatccagcgccagattattcaaagtaacgtgattggggtggcatggggtggcactgtccttagcgtcatcgataattttcaaacgagcactcgtgacgacttactgttcacccagtttatgggtgataacctgaaaacgaacgcagcgaacggctcaacaccgttggttcaaaaagccgccgctaagttcggcgcacagtacgtcaccatcccggcaccactctacttgtttaatgatcaagcacaccaagcattggctcaagaaccagccattacaccggccatcagtaactttgaccgaatggacatgctatttgccggaattggcaccttagcatccattgactcgattcccgtctggcatcaacatcgccaagccattctgggtggcgctgatccgcgtgcggtggtcggcttgctatacggtcggccatacgacatcaatggtcacattctgaacgccgaccatgacaaactctttggcgctaaaatgcccgccattctcaaagtgccgcgtcgttttggcatcatcaaaagtaagttcaagagcgaagccttacttggcgccctccgcggatgaacaattactcactgacatcatcattgatgaagccgtcgcgaatcgggttctccaagaagatcaagccacaccactatccaaataatccgcttcttcgaaaacaggtaccaacgctgaccgttgccggcagcttggtacctgtttttatgcttaaaatcagactaccaaataccaatcactttcatccagagggcgccaatgccaccccaaacgactaggtagaagagacctaaaataaagtttaactgccaccattttccctgagtaacatacccagaaccgaagagaacactcgccgggccgttcgcataatgcgtcgtcgaagcgaagatcgaaccagtaaagccaagtatcagtgcagcaaaggttgctggcgctcccgcggaaaccgcgaccccaagtaaggcaccgtacattgcggaaacgtgggcagtcccactagcaaacaagtagtgactgtagaagtagaacaagacgagtgccgctaaaacaatgccccccaactgaagcctttcaaggcaccaccaatcgcgccagacaaccatggaataaagccgagtttgttcaactcattagccatgaagatcaaaattgagaaccacaccaaggtattccaagcaccagtttcgtgtagcacgtcatctaccgatagaactccagcaacgagtagcaaggagacggccataaaggcaactaatgaagcttcgagaccgataaagctggataacatccataagactaaggctagcaagaagacgccgcccatgatttttctggaagactcatcttacccatctttgccagctcatcatccgcccattgcttggcattgggcgtatctttaatttctggtggatacattttataaattaaatatggcacaaccaataaacaaataagtcctgggacaatcccggctaagaaccattgcatccacgataacgtgatgtgtaaactcttggctaacgtgacagcaactaagttaggcgccatcgccgtcatgaacatcgtactggtgattaaatcaccatgaaattctgcgaacactaagaatgaaccgattttactttgtgtgccatccttgggatcagaaccaaacgtttcagctaacgactgaatgattggataaacaatcccaccagcacgggccgtattgcttggcgttgcgggtgctgttactaaatcgacgccaatcagtgcgtatgccaaacccaacgttcgtttcccaaacagccgcacaaacaccaacgcgacacgtcgacctaaaccagtattgatgaaaccacgtgacataaaatacgccatcgcaatcatccataccgtactgctcccaaatccggcaaccgctgtatccataggcacgatgcccaataacacggttagtgtcaacccaatgattgcgaccccggcgattggtaacggccgcgtaatacaaccaataatggttgccacaaaattgccagaatatgccatgcgttcatcgaaacactggctggtttatgataggactacttaaccaaatgatcaggcccaccaataacggtgcaataaaatcacgatacttgaccttatttagtgtcatctcaattcctcctcatacttactcatcatttttatgatgccacattcatcatggtcagcatcttggctgcgaaatgttgcatccgggcacgctcatcatctgatagctcagcttcgatcactttttggagcccgttgcggttaataatggcgggtgaccccaagtacaaatcgttaatgccatattgaccagacaaagcggcggagacaatcaactcagcattttcatcgttcaaaattgctcggcagatttgcatcaaactaacggcgaccccatagaacgtggcccccttctgactaatgatttgaccacctttaccacgaacagcttgctcgatttcagctttgaactgatcatcgaccgttgtgaccgtctttaagggctgagcattgatcataatttcatcaaaattaacgatggaactatcaccatgttctccaagtaccgcagcatcaactgcagtggtggcaacattcaacttctgagccaaggcgacccgtaaccgcgccgtatccaaggaagtcccggtaccaatgacccgatgccgtggaaaaccggataaacgttgcgtcatcgaagtcaaaatatcgacgggattacttgagataacgaagcaaccattaaaaccactcgcaaccactggtttgacgatggattccagaatcttcgtattgcggttaatcaaatctaaacgactctcaccaggcttacgaggcacaccagccgtaatgacaacgatgtcagcatcatgcgcatccgcatattcaccggtatgaatgttggtcgcattcgtaaaggcggcaacatcttccaaatccttaacgtccccctctgcgtgcgttttaaccaagtcaacgataacgagttcatctagggcgcaattttggaccaatgaaaaggcaaatgatgaacccacgccgagccatcaccaacaattacgactttgcgttgcttcttatccatgtcaatatccttctttcatcaaaaatgtgtgctgcacatgtggttccaactacttagttacttaactcacaagtattataacgcaaatgctttcatttttgctaatttttaaaaataaattattttttgaaaaatttaaatataattattacttaaaacgcctgtgtagcagcatttaaaattattttgattgtgaactttttctaaagtgtcggcttgtgaaatcattttcgtaatcggttacaattctgcgtttaaattgcctgattggcgtcaattcgaaacatctgcgcaagttacaaaactttttacccgccaaccgatcttgaaacagttaaaacctgattagcgtggtatattagaagtacgactcaaactagagaggactaatacattggataatgaaactttaaaagactatctcgcaaacaactcccaagttattaccatttttttatggagaaagcaaccgattttctgaatcgaaaaatgaggaccgggcgccagcacgccgctataacgatgctgaaatcgcccggcaagcggataagatgctcgatgatgtgattgccaatattcatgataaaatcgtcccccatacccgcgaacaaacaccggctgcctgggaacaatttctgagtgaaaacgacgtacttgatgatctggaactatcaatgacagaattgtcattcgaatcggaagactaaactagcagttcaaaataaagaaaggaccgtggaagatttaacttccacggtccttttagaacaaacttatatcacatgacatcaacacaaccgaattataggcccaagtactacgaccgagtcagcccagcataaatcttatcaagattccacttcaacattgagtagtacgtatcacccggcttgcctttagctgccagcgaatcggtaaaaatcgtactagcaacggggattccgtctcctgtgaaagcttattcatcgatttcggtgatacggatgattcgacaaacaaacttcgaacctgggttccttcaattttcttcaacgccgtccgcatctgagctggcgtgccttgcgattccgtattcacttcccaaatataagcagcgggcacatggtaggccgccgagaaatacttaaaggcgccttcggatgtcactaataatcgttgactcgtcgggatctgcttgaatttggtttgagcgctctcatgcagttttgttagttttgccacgtagcgatccgtattcttttgataaacagcggcgtgcttaggatccttggcccgcaacgtccggttgatgttcttgacatattgaatcccgttggcgagatctaaccaagcatggggtccggctcattaacgttcgtcgttaaatatttgaccttaattcccttactggccgcaaaaacatcgtggtcaaagtcctttttggaagccgtcactaactttttaaaccagccatttaccgccagtttcaaggtttaagccattataaaaatcacgtcagcttcggcagttgccgcaatatcagtgggccgtggttcatactcatgcgggtcagtgccgcgcttcacaatactgtaattttggacgtactgcccacccacatttttcaccatatcatctagaatcgagttcgtacttacgacccggattttggcactagtggtcgtcgctttggcactttgctggcgttgattcagaaatactgccatcccggtaaccatcgcgatgactccaatcagtgcaattaatttcgttttcatgctgtcacccgtcgcgctgctgcttgccctttccaaagcgtcggcaacaaggcctgcttaggtgagatgatgaaagaaataccgaagaaaatagccgctactagcacgatggccggaccagaagcccagttcaacgtgtagctgagatataagcccaccactgaggacaagaccccaattaaggctgacagtccaaagcatgactgccagtcgttctgtccatagaaaggccgtcgcagccggtgtaatcaacatcgcgaccactaaaatgatcccgacggtttgtagcgctgaaacggtcactagcgttaagaccagcattaacgcgtaatgtaacagttggaccttgagaccataagtcttcgcaaaggtcggatcaaatgacgtaatcagtaattccttgtagaagaagaccacgaataaaatcactagtcctaacacgaccgtcgtcgtaatcatatcagtatcactcacagcgagaatgttaccgaataagatgtggtgcaagttcgtcgaactttcagctaatgaaattaggataaaaccgagtgcgtaaaacgcactgaagacaatcccaattgaggtgtcagtcttaatcttactacggctcgcaacgaatccgatcaagctagcggctagaattccaaaaaccgaagcaccaattaggacgttgataccgagcatataagctacctgcgcaacaccaggtaaaacggcatgcgagatggcatcgcccatcatcgacatgcctcgtaaaataataaagctaccaataattcctgacatgaccccgaccataatagccgtaattagcgcactttgtaagaaatcatacttccccaaagcagccataaaggtcgtaattgattgcatcatcgcgtttcctccttcgtaaacaggacggccgaaagatcagcactaaacgtccgttcaatgtttgcgggtgtgtagaccgcgtccacgggaccataatcaacgataccgtgatttaaaatcacgagatcatcaaagtagcgtgaaactttgttcaaatcatgatgcacgacaataatcattttgccggcatcacgccactgatgcaagatcgtcatgatagccgtctcactctgtaaatcaatgccgacgaaaggttcatcaagaataatgatatcggcttcttggactaaggctcgagccacaaagacccgttgtaattgtcctccagagagctgactaatttggcgctgtgctaaatcggctaactcaagttgctcaagtgcatcttggcaacgctgacgatccgccttgcttggttcgcggaaaagtccgagtttgccataggtcccagtcaaaacgacgtcaaaaacattgattggaaaggttaagtcgagatctttacgttgctcgacatatgcaatctgtttttgaaattgttttagcgcacgaccttcatattcgacggttcccgtttgggatttgatcagaccaagcattgccttgatcatcgttgattttcccgcaccgttgggaccaatgattccagtaattttgccggcgttaaagttaacggcaacatcagtaaagactggtgtgtcactgtatgccacggtgaggttttgtacttttaacatcacatttcctccgttcatcgcggtagtcggttttctacatcgtcataagcataactgataattaacgctaatgcaaataattgttaaggtacagttaacttttttataatcggtattaaattttcgttcattctaatactatttctgcttaaccaaggcgttacaaccaacatactaaatgcttaatccagaacctactgaaacgactttcgatgccatcaccactaaaaagcactgaccactcatcaactaagcattgcaatcgtcatttaatttccattaatatttggtattaaaaagtgtcgtcacctacaatcacgacactcattattaagctaatatatctgtctgcaatccaataaaaatcgtcaaaatcaacaaatcggccgagccacctaaactatagttatggtcgacaaaaatctgattcaattcgcgtaaaaacgccattccagcttcactgcggcttcccctaaatcgaagtagcggtgtgcttggtcgtggacccagtcaatgacgtgcgggtcgtgtgcccgttttaccagattggtatcgaccgtcgcctggacaatcgccatcagtgtgtgtccctaataaccgctgattaatcgtgccacgactacgtctcaatgcgggtagtgccacttgcatcacggtcggataacccgcctcggcttcaccacgaattcccttgatgccatatgttaagtattgacgttctccagcagttaaggtcgttggatccttcgtgtttaaatcattaaaatcatttgccgttaaccccgccagcatcgtgcgcacaatcgttgctaagtcgacgtcggggtgctgcaactgatacgccgccgctgtcactagcacgcccagtgagaacaccgcccctttatgggtattcacgcccttggtcgccgcaaacatggtttgttccgcttgaacaccaatgccccgaatttgcttgaacaaacccgtcaaatcgacagccgtatacgcgacgcccgccgctgcacaagcattaaagtaggggctagactcaaagcactatcaataaacataaaagcgttcatgtctggatggggacccgccgacaacgggtcggtcgaccagcccgggcttagggttgaccgtcacttcgtataaaagcgctcgtagcgcatgattgacaattatcttcgtatccactatttctccaccatttcatccttagtctaacaacgatgatgtgcctgggtcactttcagtcttgattaagcgtgaccacaaccaacattcagttaccattacttatatttccatcataactgatactagtcaatttttgtcatttttctttgtattcttttgtcgactgctgttcaagcatcttctgaacgtgtaagctagagctaatcaaagttattcctaaggaggacactgtcatgatacctagtcagcattttcaatccactccaaccgtccaatttgacttattaacatacatgattggtagttaccactacaactggcatccgcaaatcgaactcttatggttattgcaaggtacggtcgaagtgaatgttgacgggacgcgccatcaattacacgcaaatgacctcatcatcttgatcaatgccaatcgcggccatgccacctttgccttgaccccagaatgtatcgcgctccgtttacatattctgcccgatttctacactagtcagggcatcgacctcagttcaggtgcttttctactcaacagcgtgacgacgccccaacaccgtgactaccaaacgattcgccaaattctggcacaactctatctaggattacatcagcaggactggccaatttttgacttgaacgccctgtactttcaattgacgaacctgctacatcacgatttctttgatactggaatcacgatgacttacccccaacccaagacgcagagttcactaaaccgggtcattgattacattaaccaggcttacgatcgaccaattaccttaaacgaagcggcaaaaatcagtcactattcaccagcctatctctcacgcatcttcaaagcggaactcggcctgaatttttacgaatatctaacccgctgccgactacaacacgccatctacgatctggaaaacccaaccacaagggtcgccgatctagctttagccaatgggtttcaggaggtcaagtcctttaatctaatgtttaagaagcattttggtcagacaccttccagttaccgtcaacacttgtcacacgggcagcgtcctgaatatgaccagttcaagcaaccgctcactcccacacaaactaccattgtccaaaagcaactcaatcactgggcccaactcacaagtactgatcaactcagtgcttgtgaaagttgcatgtataaactacattttcaagaatatcaggcgctcaaacaaaaaatcgcgcaattaaaaacactgctcaatcaataattaatggcataacaatttttgtgattacgaacaactgaacttaccgatattttgatcaaatattgggtcataccaaggtacgacggcatcactcgtcagaaggccttggtttttttgtcatttttaaccggctacctgtccgcttaaaaccatcactttcacaatctgatacctggcataacttggcgagtagcggttagttttgtatcacacagttacttacaatgtagctgtaaattgataggaggaaaccagctatggatacaatgacatacgactataccgaaccaacgttatcaactaagggccaacggatgcgcgacattttggccgattatattgcactcatcagtcatcgactaccagatgatgtgactgccaaactcgaagaactcagtaagatcgaagtcgatccactccaaaagctcgtctacgacacgatgatggaaaaccaattacttgccaataaacttaaacgcccaagttgccaagataccggtgcattacaattcttcattaaatgcggcgcgcagttcccactattaggcgaactcaatcaaattttgaaagacgccgtttatcgtgggacaaaaaagcgccactccgacataatgctgttcagacatttgacgaatacaataccggtatgaacattggtgacggcatcccctcgatttttctgcaagttgatggtaatggcactgacatctcaatgtacgtgtacatggccggcggtggctgcacattacccggggctgccaaagtcctgatgcctggtgaaggttacgaaggcgtcgtccgtttcgtgatggatcgcatgacgagctacggcattaacgcttgcccacctttactcgtcggtgtcggcgtcgccacatccgttgaaacggctgcgcttaattctaaattagctttaatgcggcgcgtcgatagtgaaaatccaaacgctaatgctgccaaactcgaacacttattagaagacggcatcaatcacattggcctgggaccacaggggtttggcggtcaaaagtcagtaatgggtgtcaatgtcgagaataccgcccgacacccatcaacaattggcgtcgctgttagtaccggctgctggtcacaccggcgcggacttatcaactttgacgcagatctaagactatgacttaccactgaacaaaggagtcgaattatcatgaaaacttaccacttaaccaccccaatttctgatgacgatattaaggacattcgtatcggcgacatcgtctacttgaatggctcactaacaacctgtcgggacgttgcccatcggcggctcgtcgaagaacatcgtcccctacccgttaacgtgacagaccgagcaattctccacgctggcccgatcattaaagatctcggccatgacaagtacgaaatgatcgcagtcgggccaacgactagtatgcggatggaaaaatttgaagaagaattcgtaaaacaaacccgtgtcaaactaatcgttggtaaaggcggcatgggaccgggaaccgaacgggccgcaagaaatatcacgccttacacctcgtctaccccgctggcaatgctgtttatgccgccccgcacgtcaataagattgttgatgcccagtggaaagacctcggaatgcccgaaacactctgggcgtgtgaggtcaaagacttcggtccgttaattgtctccatcgatacgaatggcgacaacttgtttgaaaagaacaaggtcatcttcaacgaacgtaaagaagctgagattaaaaaaatcaacgaacaagttaaattcattaaataaccgaccattaacagcctaagcggatcaccccgcttaggctgttggtctaaaggagtctttctcatgattagtatggatacacaatctactttaaaaacccaagctttagccgctctgagtaccgtgatcgatcctgaacttggtgtgaacattgttgacctcggtttgatctacgatgttgcttacgatgctgacctaaagctctgcaccgttaccatgacactgaccatcatgggctgtccactgacaggctatttgaatgaccatatcaaaagcgcattaatgaccgtcgcgggtatcgatcaggtactcatcaaccttgtctgggaaccggcctggtcgcttgataaaaatgtcacgggcagcaaaaatgacattagggttgcattaattctaatttagaaatcgtgtccggattagcatcatttgctgactagtttcagcagtcaccgtgagacgattttaacgtttgactagaaaggtggtcgttttcgatgaccaaattacaatccgtcaactaccagcaacttacatggccgctgataattggtttgattatttggctgagcgcgccatttcgtcccgcggggctcagtctattagcatggcacatgctggctctctttgttggcactatcattggttgcattacccagccgttacctattgccggtgtcgcaattattggtctcacacttggtgtcttacttggtgttacctcgatgacggatgccatggccggctttggtgataacacggtttggatgattgcaatggcttacttcctatcacgaggcttcgtaaaaacggggctagggcgacgagtcgcgctggtcttcgtcaaattattatgtggtaaaaagacccttggattagcctacgcgctgattggtgtcgatctcgtcactagtccggccacgcctagcaataccgcccgcgccggtggaatcgtcttcccaattattgaatctttagctaaagcatacggctctgacccacaaaacggtacgcagcgtaaggttggtagttttctcattatgtcagctttccatggtaatattgccaccagtggcttattcatgaccgcgatggcaccaaatctcgttgccgtggccttggcccaagcaatgcagattcacatcacatggatggactggttactcgccgctctattacctggtcttatttgcttaattagcgttccagctattatttattggctctatccaccagaaattaaggatacacccaacgcgcatgcgtgggctgccaacgaacttgagcagatgggggccatgactttggccgaaaaactcatgggcggtatttttatgttggcactctttctttggtatctcagctagtctcactgggctagacgcgaccttagtggccttcatagccgtcactttgctcttattaactggtgtattatccgttgacgacttattacatgaaactggggcttggaacacactcgtttggttttcaattcttatttttatggctggcaaactgaacagtcttggctttattccatggctttcacaaactatgggccaggccccgcaaggaatcagttggctatgggtcttggcagctttgatgctcgtttacttttacagccactacctgtttgccggcgccactgctcacgtctccgccatgtacggcgccttcttgggtgtggcaatttcagccggcgcccccaatgctagcagccctactattaggctttgacggtgccattttcagttcgaccacccattacgccaacggtcccgcctcgattatgttcggatcaggttacataacgcagtccgaatggtggcgtctgaatctgtgccttggtggtttctatctattagtatggggcgttggtggcacactctggatgaaacttttaggctattggtaaactagttgtttttcaactatacaatttgacaggttcagacactcattcccgtatttcccgactccgggctgagtgcccatttctggggaaggacgatctagccgagcgagtttacgcaaatcagaacttttgccggtgaccctaaactggctttttaaactcaagactggcatattttaatgcatgcttcatgaaaattaacgcgcacaatgtgaacttactcctgactaacgacttgatcatacaaacatcacgcctaaccaataacaatcggctttccaactattacttggaaagccgattgttaatctaccatgtaagtccatcagaacctggacgtcaaaagttctgatgctccctcaaattttcagatcccacccggctaaccgtcatgtgtcgaactgaagcatattgtaaacttacgtctaatcactgacaccgaccacaagtcacccatccaagtcgccaagtccgtgaccgctatgggatacaggtggggttgcccaaccgccgataagtagacccaggtcagcgctgtaccgtgcacttttttgtcgtgttgcatcactgcggccacggcttgcggcgctatcggcggtaattccgtgggcaaccctaccgccattaagcgtgccttgagcgtcgacgttaaattagtcggcgctaacccatgtgctgcaaacaaccgacaaacctgtactagaccaatcgctaccgcttccccatgcattagttgaccgtcagccaatagttcgactgcgtgaccaatcgtatgaccaaaattcaataattgccgctgaccctgttcatgctcatccgccataacgacgcgcgctttgaacgccacactagctgcaattaaatctggtgctgctggtaaaatcgctgccacactggtaatttggtgcaaggattgccaaaaatcaccgccataactaatgctgcgcacttaacgatttcgccataaccttctgcgagcatccgtggcggtaacgtcaccagaattgccggatcaatgacgactaaatctggttggtaaaaactgcccactaagtttttgccagttggtaagtcaatcgcggtcttaccgcccaccgaactatcgacttgcgctaataatgatgtcggtacttgaatcaaggcaataccgcgcatataaatcgaagcgacaaaccccgctaagtcaccaaccaccccgccaccaagagcgaggacaccgtcactgcggctaaaatgggcggcactcagctgatcgattaacgactggacttgtgaccaacttttgctctcctcaccggctggaaccgtcatcacgcgcaccttgaatccagccgccgtcagttcatcagttaccagcttcgcatagtacgggcccacattggtatccgttaccaccgctacttgacgggcacaccataccttagttaccaatgttcctaggtgatgtaaactgttaatcatgatcttgatctgatactgtttaactcgcgtcttgacttcaatgtttgtcataggcacatcctacgcccacgtttgcatcagatcatgtaactggaaagcctgttgcgccatttttaagtacgtcgcgggttttaacgcttgcggcccatcggataaagcttgcgttggctggtcatgaatttcaacgatcatgccactggcgccagctgctacacccgccatcgccatcggggtcacgagttcccaggtaccgaccgcgtgactcggatcaacgatgactgggtaatgtgtcaacgattgcaagactggcactgcacctaagtcaaacgtgttgcgtgtgtacttattatcaaacgttcgaattccccgctccaaaagcatgatctgatgattaccaccagctgcaatgtattcagctgcattgagcatatcgtcgattgttgccgacattcctcgctttaatgcaaaccggaatttgggtctgtccaacggctttaagcaacgagaaattttgcatattgcgtgcaccaatttgaaaaatatccgtgtatttcgccaccatcgccacgtgttcatcatccatcacttcggtaatcatatcaaggccatgtttatcagccgccgtccgtaagtattggagtcccgtctccccgaggccttggaagctgtaaggtgacgtccgtggcttgaatgctccgccacgaacaatcgtcgcaccaccaccgcttggcaaccgcggccatctggtccacgtgttcagcgctttcgactgaacacgggccagccatcatgacgaattgattaccaccaatcacactgtgtggcgtcttaataatcgtatcttctgggtgaaagagacggctgctttggaccgctgcgggaactgccgtcaagattgattcactggctgcttgcacatccgcgggaagtgcttctggacgcaatccttgaattgcaattcgattatttgtgcgtgaagatctcgtgatccgcaccaaattgactcactaactttgcctgcatagccgtagcggttgctggttttaatataataatcataataatttcctcctactaatcaattctcaaaagttaaggcctaagcacgcgccgtaatcggcggagtcgcttgaatactggctaacatatcttggcggacctgttgaactggcatctgcttaccagtccaaaactcaaaagccaaggcaccttgccaaatcaacatccccaaaccattatatgtggcgcaccccgctgacgcgctaagcgcaaaaaggtcgtttctagcggttggtaaatcacatcatagaccgtctgttgtgggactaattgctggataattgagattggtaatggcgttccagcagtcgtcatgccgatattggtcgcgttaatgatcaaattgctggtacgagcaacttgctgcatccgtacttggtcttcataggcacagagccggagtggtacccgaagtcgtggtactgagttgctccaaccagtgctgaacaccggcgtagcgttcgttgttgcgtttaaagaccgttacactcgcgacaccataatctaaagccgccgcaatgattgccttacccgcgcctcccgcgcctaaaaccatgacgtgcttatcaaccaagttcagaccttgatgtaagagatcctgaaaaactccagcgccgtccgtgctgtcaccaatcagcttgccagcttcattcttaatcgtattgaccgcttgaatccgttgcgctcgcactgtcaaaccatctagtagcggtacaacggtttgtttgaatggcattgaaaggttcacccccgcgatacccatgctacgaattccagcaagcgtaccagccaatccatccggtgccacatcaaacgccaagtagcgcgcatttagccccagtagtcaaaactcaaattatgcattcgcggtgagcgactgtgccgcgcggggtgcgcgataaatccaaaaagagtgccgtttgtccatcaatcatgctttaactaacttcctttctaaatgactcgcaattgttgaccaagatccacgtgcgtttgttgatacgtccgcactaggtctgctaccgtgaactggttagcggctaatacttggtcggccgctccactggcgccaaagtggtccaagcctagtaccgccccatctaacccaacgtaacgttcccagccagatgttgcgcccatttcgactgcaactcgccgccgaatttgaggtggcaagacctgagcttggtaattcgttgattggcgcgcaaagttttccatcgacggcattgaaacgacactgacatcttcacctaacgtagctagtttcgcctgggcctgaagagctaaagcaacttctgacccgcttgcaatcaagattcccattggctggcggccacgctgcggtgagagaacataaccgccacgagccacaccagtcatggccttagtcttagatccggatagcactgccaaattctgacgggtcaagacgagcacggttggatgatccgtcgcgttgatggcttgccaccaagctgcgaccgtttcattcgggtcagcgggccggatcaccgttagattcggaatcaatcgtaaactcattagctgttcaattggctgatgagtcggaccgtcctcgccgactgcaatcgagtcatgcgtgaaaacgtaagtgactggtaacttcatcatcgccgccaatcgaatagccgcacgcgtgtaatcggaaaagacaaggaaggtgccaccaaagacccgcaagccaccgtgtaaagtcatcccattcaaaatggtgcccataccaaactcccggacaccaaaggcaacgttgcgctgatccggggtcaccggagtcgacaattgatcctgctcaatggtcgttttattcgaactggctaaatcagccgcgcccccgactaatcctggtaactgagcggctagcttctgaatgacggtatgacttcgtgatccgcgaagcttgggcgccttcatcaaagatcggtaaactggtggctaagtcaactggcagacgcatactgagctgttgttcgaaacggtgttgtacggcttgtggtaaagcctctcgttgtgactgccaccggcgatgtgcacgctgaccacgttgcaagattagttgctgtgcgcgtttagcaacggccggcatcaccgtaaatggcgcggcttgccaccctaattgttgccgcaaactagttaaaccggccgttcccaacggattgccatgcaccgcattcgtacccgcttgtggtgcgccaaatccaatcgtcgttttaacagcgatcaggcttggacgtgaactgtgtttggcacgctcaatggcggcattaatcgccgttaaatcattgccatcacctaccgtttgtgtatcccaaccataactagcgaagcgctggttcacatcggtacgaaacgaccggctggtggggccatcaagcgaaacagacgttatcgtcgtacaatacaattaatttttgcaattgttgattaccggcaaagctggcagcttcgtgggagacgccttccatcaaatcaccatcaccgactaacgcataagtatagtgatccaccaactgcggtgactcggagaactgagccgctagttgccgttcagccagggccatgcccaccgccatccctaatccctgtcccagtggaccggtcgtggcttccacaccatccacgattcccagttcagggtggcctggcgtatgactgccgaattgacgaaaacgttgtaactcgcccattgtcacgttgaagccactcacatgtagcagactgtacaacaacgccgacccgtgtccggctgataagacaaagcgatcgcgattagcccattgagactgctgtggatcgacccgtaattgtcggctccacagtgcccacatcattggagccgcgccgagtggcaatcctggatgaccagaaccggcccgttcaatcatttccgcactcagtactcgtagattattcaccgctaattcatcaatttcatcaaatgcttgcattaacttcgctccctctcattttggctaataaaaagactcacagttacaccaactgtgagtccactaattcttcgcggggtgcccgaaaaacaccgctactcagaagcagaaaagtcacacagtggttgttcacaacactgatatgacttttccataaattttaatcattccaaaatttactggtcacatccgttgcgagggcgtgcctcgcagtggatgccaaggcactaagtaaaccagtaataataatacgaattcaattgtaaattggtattaatcgtcatgattaaaatctccttaatttataatgtgtatttgatgacttaaaatatacggctaatcaatagaattgtcaaatggtttttgcaaactttttctattaatcaacaaaaacacgttggtccaccctcgatttgctagtcgtcatcatcctcgctaactgctaataaatactggtaaatcagcaagtttgcgtgtcaaatcattttacagatattaaaatggttccccgccactttctgaaaatatttttagccagtagcttgcactgacttaacttataatccaccgccaggcaaatcattaaagtctaaaagccgcactccaacgctaaatttctcacaacgaacgactgacaaacggtcattttcgattacaatttcaacaatgttccgtatgctttagcaactaaccttagccgctcgtcagttgtctgaactgccatctatgcccaaccagctagctggtcttcaccaccgcacataatcgtgataaccaaaaatagtgtcgccagcatccagagcagattccagccacactatcatcagtttatgtgatccccattttagtcacaataattgccgcaactacaccaaactacgctttcaaggctgcggggactgccactccaaattcagcaccaacttgctgcatgtttccgtcaacgtctgtggatcaatactgacgccccgcaccaaattttcatcatagtgccggtattcccggtcacctggtatcataatcttagtacctggtagatgcttcaaatgccgaatacggtcaaacatagtcgtcacgttggccttcaacacctcgggatcgccaaataaggcgggattaatcgtcatgaagaactgactaaagtcatgcttaccggtgttcgtatcagccgacagcgacccttgcgctaaaattcccgtgagtaactcaataattagtgagttgccaaagcctttgtaatttgaattgacttcccgctggccacctagggtcaggaccccaccaccaggacgattctcagaaaacgcaattttagccaagttatcctccaccgtctgcgcatcatgcaagacttgacgatgctcatcaaccgcccaaacacccggaatctgtgcacctttttggccagcacttgaatcttcccgcttgaaaccaccgcagtcgcgccgtcaaaaacgaaaggatgcgggtcggctggaaaagtaaaagctaatgcgttggaacccaaaaagcttctgtcgcattcgtcggcaccaccaacggccgcgtattagtcgttgaaataccgatcaaacccgctttgcaagccatgcgcgaataatagcccgccgttccaaagtgattcgaattgcgaataaccgctaatgaaacaccgagttgcttagtcttttcaatcagtttattcatcgtaaacgccgacgcaatctggcccatgctctggttcgcatcgatcaatagactggtaggtgtttcattcaaaatcttcggttgatgcgtcggttccaaggtatgatccttgatcatccgcgtataccaagccagccgctggataccatgtgacgagattccacgtaaatctgcatcgaccagggtgtctgccagcagtgccccatccttggcactaaaccgttgggccttaaaaactgcttctaaaaattgtcgttccgtttccgcactaattcgcatcgttatattttcctccgtttttgacagccagcactcgcctaacttggcgagcaccgggatatcacactttattcagattgctaaacagcttgaacacgttcattatccgattcctaattagaaaattcaatgttttatgtaaatataattaaaaacagatgtgtaaaacgttaatttttcaattatgccccactcagtttctttccttaactaacctttcactatccgctaagcggcctgtctttccatgctatattgaagacacttaaactagaggagggacccgcgatgcaccgttatacctatcatttttatacaggactaatcacgggcttgttaatttgggtccatccctcggcggtctagctagtcgcatacgaccgacactaccgtacccaccaaccacccttcaaagaacagccacccaagctgttttttcaccaaccgaattttatcaaaccatccgtcccagtatccggatctggttaaactagcaaaattcgacccaatcggtatgttgcaaggcaccaccattcagccgggactacaagccaccctgactagggacctcgtcactaaacaactcacgacgacgacaatgatgattccacagggcgttgttattgccagtcgttatcgtctaaccaccgcttatgatgccactggtcgaacccaatctgtcctatatgtacaggatcgtttccgacatcaattatgcaacactgtcttattgcatggtaaaccacatgtgggtggtctagcttatgaccctcaccaccagcggatttggttgtgcagtcatcgccacggtcatggggctatcgtgagcgttagtctggccgcattacggcacttcgacccgaccacttccattgccgttcactatcagcaacgctggtcactgccaacactgagcaatgcttcactactgacctatcaccatcaggccctttatgtcggccagttcaaacctggacagaccaccttggttgcccgctatccactgacgagcgccggcacgccatacagaatgaccacgagtcacgccattttaccaaaggcagttagtgactggcacggcaagctcccacccaatattcaaggaatggccttctatgaccactacgtcttgttatcacagtcatacggccccagcgcctcacacttactgctattcaagcgcagccaattaattcaacagcatcaactgaccaccggtatcgcgattcttcgattgcctccgcaactcgaacagatcagcgttcatcatcaccaggcgcaactcctttatgaaaccggggccacctcctaccgccagcagcaaaatcacgccattgatcggctgatttcaatcaacttacagcgcctcattgaataggcaaattagtcgtcgaacctcatcgccatgactgaaaagtacggtcctagttactcagtagtgttactacgtcattattgcagttaacccaatataactgaccttccgatgcgtccagtatttactgacatgcccagttcaatttcctgatcagcattcacgctgctaccaggattgcgacaaccaactagttgttaccgtaaattactgctgtacgtaaaaatacagcatgtattaattttccatggccgcccaaataagcgtacaatgtaacagtaagtacaattaagggagaaagttatgtatcagctattaacagattcaaccgttgatttaccttatcaactacttaaggacaagcatgtcgattttgtttcaatgaacgtcacgattgacgaccaggaatacgcggacgatttgggtcaccactttgacttgactgacttttatcatcggattggtaacggtgtgatgccttctaccgctcagattaatatcggccagtttattgaatttttcaagccgtacgttcaggcacatacgccaatcctatacctcggcttttcatcaggcttaagtgggaccttcaataaaatgcgcaacaggccaagaccatgcttttacaagaccagccagatgccgagatctacctcgtggattcccgagcagcctgctgcggtgaaggcctgatgctactagatgccattgacaagcgcgatgctggtatgccgatcgcccaattggcggattggctgactgaaaaccgcctctattatcaccaatggttcaccgttgatgacttaaattacctttatcacggcggccgggtctcacggacctccgcgacggttggatcactcttacagatcaagccagtcatggacgtcgacccactcggccacttgcgtccagtacaaaggtgcgctcacggcgccggtcactgaccacactagttaacaacacactagctgatttacgtgatcagaccaagccgcgcattatcattgccactagcgacgctcaggaagccgcccaaaccgttcgtgaaaagattttagccaaggttcctgatgctgaaattttgctcgaacaccattgggccgactatcactagccataccggcctcggttgcgttgccgtcttctcttttagtaaaactaaacgtcagtaattaaaatggattgagccggcaatggcccaatccatttttaagtaaccgagcgttacttgcttagtttgtttcaaggcgggctatattcgaaccaattagtatcaaataaaacccgcccaaatgggttatttatctcgttgagccacgtcatatggtttttttgtggtttttttctcactcaacaaaaaaaagcacccgtccatagacaggtgctttctcatatagccagaaaatgttgataaaacaacgtttttggataatattaacgttttgagaattgtgaagctttccgggctttcttcaaacctggcttcttacgttccttcatacgagcatcacgagttaagagacccgcgcgcttcaaaggagtacggaaatctgggtcaacttcgagcaatgcccgagcgatcccatgacgagttgcgccggcttgaccatggaagccaccaccattaacgttaactaaaacatcatattgatcagttgtttcagttacttcgaatggttgtaacaattccttgcgaatatctgcaaatggaatgtaatcttcaacagatttgtcattcataacaattttaccagtacctggtactaagcgtacgcgggctactgaatctttacgacggcctgtgccgcgatattgtacttgagccaatgtagtttcctccttagattaagttagtgatgtccaaaacttcaggcttttgtgcttgttgcgtatgttctgcaccagcataaacatgcaacttcaagcccatcttgtggcctaaagagttgtgaggaagcatacccttaactgaagtttcaatcaatttagtaggttcctttgccaagaagtcaccggcagtccgttcctttaaaccaccagcataagcagtatgatgataataaatcttccgttctgctttcttcccagttaaagcgaccttgcttgcattaataacgataacgttatcaccagtatccacgttaggggtaaaggtaggtttgttcttaccacgcaagattgatgcgacgacagttgaaagacgacccaaaggtacatcggttgcatcaactacataccatttacgatcaatttcacctggtttagccatatatgttgtacgcacgttgtgttcctccattttctgtgtttgtttgacactcaataagatttcggggcttatcgtggggcaaacaataccaacgactagtctacccaatttcgcctcagaagtcaatactttatcaaatcagcttgtaattcattttgttcataatacactttttttcatataaagtccagccgcgaggagccgttccccgcgcttgctcacggtccttagccgctagtaacgctggaatacagtcaactgcgcgccggccctgaccaatttccatcaaaacagccaccatgattcgaacctggttatataaaaaaccactaccgcaaaattcaaactgaatttcgcgttcatccggcaaggcccacgctttggctgaatagatctcacgaacatggtcatgtgcttgtgaaccggacgcaacgaaggtcgagaaatcgtgccgtccttctaagtcaccgatggcttgctgaattcggtcgatatccgcagcgaacttaaaatgccccgtatagtgccgtttaaatggatctacaaattcattttgataggcccgataccagtaccgcttaccgaccgtatcataacgcgcgtgaaaatcattcggcacaatggaaacggcctttacgattgtatccatcggtaacatgctgttcaggccgcgccgaaccccttctggattaatttcgtacggcaagtcaaaatgcaacgtctgtccaaacgcatgcacaccagcatccgttcggcccgcaccgtagatcacaatcggttcaacaggatctttcgccatcttattgaccgccttagtgacgacccgctcgacagttcgctggtgtggctggcgttgaaagcccgcaaaattggtgccgtcatatgctaaaactactttataccgcgtggtcacaatacccctccagttaaaaacgtgggtcgccatcagtgcgacgcccacgttaatcagtcttcatttatgcacgcaagaaaatcaatgcaacggtcaagatcgcaaagcatccggtagcccacgtatcacgttggtgccacttaagaatccggtacttactgcgaccctcgccgccttgatagccacgtgcttccattgccgttgctaaatcctcagcccggttgaatgagctgacaaacagcggaatcagcagcggaactacggcacgcatttgttgaaagatattgccctcaccaaagtcgaccccgggcccgttgtgcattcataatttttttccgtttcgtccatcaacgttggcacaaagcgtaaggcaatcgacaacatcagtgccacttcatagactggaaaacgaaaccgctttgagcggcatcaaaatatactcgatggcatccgacaattccagtggcggcgttgttagagttaacagcgttgacataaaaataatcaacacgaaccggcaaaaatatagaccccgttgatcaatccaagttggctgattgtaatgatgccccattgaaagtaaacgtgcccgccacttgcactaaacaacacttgcgggatgacggtgaataagatcaaccaaatcagcggtttgacgccgttgatgaagaacgaccatttcacaccggataggtaaatagcggccaatgtaaaggcaaatagcaaggcataggtcgcccagttattggcaataaaaataatcccaataaaataaaaactcaataacagtttcgcccggggtccatatggtgaaccacggagtctcccggaatgtagcgaccaaaaatcaatttattcatcatgagcggccacctccccatcgcgttcggtggcaactgttggacgatggctgctgctaattcgtcctcggtcaacggccactcatcaaattgccagccttgcttttggagtgtatgcgcaaaggccgttgttttcggtaagcccagttgatgggcagttagccacgcaggatctttgaagatctcacgaggcgtccccgttttgacgatttgtccacgatccatcacgattacattatccgcgtaattggcgacatcatccatctgatgggtcactagtaccacggtcaaatcacgttcatgacgcaaacgggcaaacatctccatcatatctaaacggccctgagggtccaatccggcagtcggttcatccaagactaggacttgcggctgcatcgcaaggactcccgcaatggccactcgccgcatctgtccaccagagaggtcaaacggtgaccgcgtcagtaacgactcgtctaacccaactaaagccaacatttcagccgcagttttcaaagcatccgcttcgctagccccaaagttctggggcccgaacgcaatgtctttggccaccgtttcttcaaacaactgactttctggaaactgaaagacgatgcccacgtgttgccgcaatcgcttcaagtccttattactcgtcgttggcgtaatgacccgttcaccaatcgtgaccgttccactagtcggtttgagtaaggcgttcaaatgctgtaaaagtgtagacttaccactccccgtatgaccaatcaaagccgtataagagccggtgggaatggtgacgttaatatcagttaacgccttagtttcgaacggcgtacccggttggtaagtaaaatctacttgtttgaacgtaattgccataaccagtccgccattcctttctctgttaaatattgtgtgggcacttgaacacccgccgctttagcgctgcttttaagcgctcagcatatggcatgtccaatcccatcttaattaaggcttctccatgctgaaaaatttccgctggggtcccctcttccttaacctcacccgtcattgatcactaagacccgattagcgctggccgcttcgtcaatatcatgcgtaattgacaagaccgttaacgctgaattagccttcatatcgcgaatcgtcgtcaatacttcctgacgaccacggggatccaacattgacgtcgcttcgtccagaatcaaaatctgaggccgcgccgctatcataccagccagcgccacccgttgtttttgaccacctgacaaacgtgccggttcacgtgtcgcaaaatcccgcatgttgacttgttctagagccgcctgtacccgcgttagcatctcaggacgcggcacgccctggttttcaaggctaaacgcaacatcatcggcaacggttgccccaacgaattggttatctgggttttggaaaaccatcccaattttgcgccgaatgtcccaaacggtttcttcagataatacttgaccatcaaccgtaatcgttccggccgctggtgctaacagtccgtttaaattcttgggccgccaaggtcgacttaccagaaccgttatggccgacaatggcgacccattcacccggcatgaccgtaaatgaaatatcgtgtaacgttaactgatccgtagcttgttgcgggtaacgataatctaaatgtttaacgtcaataatcggactcaccattgtccctcatttccttaaaattcatggttattatcataacatatctgacggaacttgtagtaactgaacttcacgtccaatcttactttaaatcagtggctggcccgtatttgtaaccagcatcgccaaacagcgtgaactgcttcttcaagttattggagacgtatactttttatccttggtaataaaaatggccccaataccttgatccgctttaccattaatgtacttcatcccgcctttgaggcctttgtcaaaggtggccgtcgatagtgcatcgccatccaccgacttcttcgagatgatggaaacgcccatcaaattgttttgataaggtgcccctgtttgtgggtccatcaaatgactgtaaactttaccattcttcttcaaatagcgttcatagatcccagaagtaacgattgacttattcttagggtagtgagccaatggccgtaccccgtgacgcttttggatcttggataccgactgtccagttacctgacttcgttcctttagggctgtcacccagaacataaatattaccaccgaggtcaataatggccgttgaaaccccatgatttaataagtacgtcttcacttgatcggtcatgtaacccttggcaatcccaccaaggtctagttgcattcccttttcttctagataaacggtccgtttcttgtcatttaatttaactttttgtagtctaccagcttaacgttcttatcaatttcttgttgagtgggcaccttggcatcggaaaatccaatatgccagagtgatgtgatcggaccaatggctaaatcaaaggattcgtctgaattcttactataatagtaagctggcctttgatcattgggtagatatccttgctgacagccactggctttttaccggcagcggcgttgatcttatcaatttcagatcctttttgattgaccgtaatttccttagcttccgttttcaacagcttaaacgccccagctaacacgttatccttacccttattataaatccgcaacgtgacaactgtgcccatcatgaactgggtatcctcgatcggcgtcttgacgaccttagttggtttggggcggctactagcagcatttttgcgactcgtactcgtcccacacgccgtcaatggcacgatcattgcaacaattaatccaattcgaacccatttttttagcttcattccaatacttcccctatttttaatttcaattgtcattataccaaagtcttgattcatccggtgagactgtttgcgcgtcatccaagcttttctacgctagtctgacatcagcgcacctacagcaaacggtacaactcgacggtcgggtttggtactaccacagccattttgcacttaacattcaccgccactattattttttaaaccaatatccatgtatggatttagcttgctcaaagtcgtgcccaactgagtgacaaacttttgtggttgttcaattaaaaacaaaaggccctcagcatgcgcctcaggcctcaaaagaatctaataattaaattgcttattcagagaaaatcatgttgtcaacagtaatcgtgttggtgtcacccttttgtgccgcgttttgtaattgttccgcgtacataataaaggtgttagaagattcagtggcacccgtgacaacgtcaaccttagttggatcactactcttaactaatgacttgttcaaagctggttgataagtcttagggttagtcttagcaaccttcttcatttgcttgttgtaagctgcatcgtcaactttggacttgccattcttgttcacttggttatattcagacttcgtaatcttattatccttgaccgtgatttttgcgaaagtaactttgtaaccgtgtgagtagttcttttcgttcaacttgtaggtaccatctttcatcttggcaccattgtcaatcttaatggtcgacttgttacccgcttgggcagcttgaactaattgttgtgtgtagttttggaaggtctttgatgattcagtcgcaccagtcacaacatcaatggagcccacgttaccagtagcggcagagcccgtcagcgtcttgtttaacttaggcatgtaagtcttggggttagtcccagcgatcttcttcatttgtttgttatatgaagtatcatcaactttggacttgccgttcttgttcacttggtcataactggacttagtgattttaccgttgttattaactgtgatactcatcttggtccgataaccatgtgaataattttcttcttcaaggttataagtacccgctttcattttgctgccagcggttaatttagcaaccttagttgtcttagctgatgagcttgagagatgaactcttcttggatgaactcgagctagaacttgaagaactgctgccacaacctgctaaagctaaagctgaaattgcaacaactgaagcacccgtaataactgatttgaatttcatgatatcccactcctaacctttttgtatgaaaattcacattaatcttaacgtttaaactggtaatagtcaatcccattccattaaaaaaatgatattttagcctaataatagcggtattgacaacgttttccgttcaaacctcgatgccactattttcgcggcttagataatgtgatagtttatgcattctttcccataatccatagacaaccgcttacattatcgttataattattagtggaattatctttttacactattattcaagggagttgttacgcaatggcaaagaaaaatattgtcgttgtcggtgcggggtttgctggtgtttacgcaaccaagaaactgtctaagcatttcaaaaaaatgcagacgtcgaggattacgttgattgaccggcattcatacttcacgtatatgactgaattacatgaagttgctaccgaacgggtggaacctgagcatatccaatatgatttgcaacggttgttcgcacggcgaaaaacgttcgtctcgtgaccgataccgtgacgggcatcgacaaaaaggcacaaacagttactaccgaacacggaagttatcaatatgatcaacttttaattagtttgggtggggaatccaatgactttgggactcccggtgttaaggaacacggcttcgaattgtggtccttcgaacaagcgatggcattgcgcgctcacttatctgcaattattcggcgggggcggcggagctcgacccgctaagcgcaaagccatgttgacctttacagtctgtggttctggttttactggttctgaactgattggtgaattaatcgaatatcgtgatgttttggctcgagacaacaagctcgatccaagtgaaatcacgctccaatctggtcgaagcagcgccaactattattaacatgctcaaccggacgcaagccggtaaggccgctaagtacatggaaaaacatggtgtcaaaatcatgacgaactccatgattaccgaagtctgtgaagaccatgttaacttaaaaggcaaggatccaattccaacctacacgttaatctggacagccggtgttcgtgctaatagtatcgttaaaaagttcggcattgaaactaacccccgcggtggtcgcttgatggccaatgaattcatgcaagctaaggattgtaacaatatcttcttagccggtgattcaaccagctaccaagaacctgaccaaccacggccagtcccacaaatcgttcaaggggctgaagaaaccgcagctaaggccgtcgaaggtattattaagaacgttgaccagactgacgttacgatcaagccatttaagggcgcttatcaagcatccgtcgactcaattggttccaaatatgccgttgcacaaaggttttagagaagtggaacgtctctggttttattgccgtgcttttaaaacacgccatcaactggatgtactacgttcagattttctcaggttactacctattccagtacttcatgcacgaattcttccggactcgtaataaccgtaacgtcttccgcggttgggtctcacgggctggtaacgtactctggagtgtgccactgcggttcttctatggtgccatgtggttatgggactgctggactaaagttcagggatctgaatcctggttcactgacaagttacggttaccattcgaatggattaccgtggccgcaaccagtggtgcctctcaaacaactaaagccgctgcaaccagtggtgcttctgaagctgccacgtcaaccgttaaagccgctaagggtgtcttcagtctttcatacatgtacggtaaagaacccctgatggtctttgacaaaatgccacattggttcgaatcaattaccaaggtcttcattccgaaacatgcaaatggccctcttcttccagaaattcatgacttgtgttgaaatcgtcattgcattatgtattttcttcggactctttacttggtttgctaacgcagtcaccattggcttagttgtcgtcttctgcttatctggcatgttctactgggtcaacatttggatgatctttgttgccctcgccttaatgaacggttccggacggacatttgggttagactactgggtcgttccgtggatgcaaaaacaccttggacactggtggtacggcaacgttcgttctcattacgacggtgttaaaacccgctagatgcgttataattaattaaatcctttcccgatggttcaagggttgtttttcccccttgaaccattttttatttcattgaattggagggttaacgatgcgtaaattacggacaatgatccggacattcaaacgttatggggatatgatcaagccgtttgatattattattattgttgcgctaattattttatcgttcaccccactagcgattttttcataccagcaaaaacaacaagctgaacatgcggcactagtggctaagcgaaaggccacgagcagtgaaaccacgtataacgccgtggtctcacataatgggaccgtcttgaagcgtgtcaatattacgaatctgaaaacgactaagcacttcacctatcgcgataaccatgggcactacaacacgatcacatttaaacctaagcgcgttgcgattacgaaagccaactgttctgaccaagtatgtgtccgccgaggctggattcataaacctggtcaaacgattgtttgtttgccccacaaactcttggttgaaattaaggccagcaacggtcaagtcaaatctggcggtaatggtttagttacggagtagaatatgaataattcatttgaacgatcaaacaaaactcatcgtaatatttatatcgcgttactggttgcacaaggcgtgatcatcggcatccttgaacggatgattccattcccgtttgcctttgccccaggtgccaagcttggtttagccaatctgattaccattgttgcaatctatacattatcattaactgacgtgataaccctaacctggctccgtttgattttaacggccctcctaggtggcactttatcaacctttctgtatagttttgggggcgcctttctcagcctgtttgccatgctgctggtcaaacaattagggcctaaacgcgttagtattattgggatttcagcaactggcggcgtcatgcataatgttggtcagctattggtcgcgagtcttattgcacagacgtggacggtcatgctctacttgccagtgctttcgattattggactagcagcgggaagtgctctcggaatcgccgccaactacttgttcacccacgtcacgatcttacgctatctcaaattcaatcgagaacaccatccagatcaaacaaaggagtaacccttatgcaatcggcaacacaattacaacccaatttggcgtgattacccggcactacaaccggagctgcaacaagtgatgcagctgatgacggcgaacatcaatattcaagatgccgacatcaatgacgcgattttagaaatgattcatggtggtggtaagctcttacgcccggcatactgcctcctattctcacaatttacaacaactgatcggcaacggatggtggccttagcggcgtcattagaaacgctccataccgctacgctgatccatgatgacattgttgacgatgctgcactacgtcggcaccatgtcacgattcaagaacgttttggtaaagatactgctgtgtatgcgggcgactacctattcgttgtggtattcaagattctagcgcactattcaagcagtttcaaaagcatccagatgaactctgagaacatggaaaagattctagtgggcgaggtccaacaaaaggaccgccactaccaccttgacattaccatggcagaatacttgcaacaaaattcaaggtaagaccgccgaattattcgcactgagttgttttctaggtgcttatgaatctggtcaaagtagtcatttcgcccagcgcgctcgtaaaggtgtctcgcaattgggatggccttccaaattcttgacgatattttagactatcaagaagtcagtcaggaaacgggcaaacccatcctcgaagacgttgctgaaggtgtctacacctcgccgttgatctttgccttacagacagaagctaagcacgatttattgccgctgatgcgattacagggggcaatttcggacactcagcgccaggaagtacaacgacttgtcatcaatgccggcggtgtggtgcaagcccaagaactcgctaccaagtacactcaagacgcgctggcaatcatgcgtaaacttccagaccagcctgcgaagacggatctgattagtctaaccaaacggctgttggaccggcataattaactagtaatcaatcgactaaggtatcaaacatcctgtttgatacctttttgtcgcccagacacagctaaacgcccatgtgcttcatcttcacagtcagtacctgagaccactatatccactttcccgattcaacaggtcataatctgcaaataacaaaccgttgtcatcacgagtattaaaaacacctatccattccaacaaaaaaccgctgatttagggaatcaatccctaaatcagcggttgctcgtaactagcaccaaaaaaatcacttagaactgcgatatgccatctatgtctaaccataaataacttccgaactagacttagctactattttgccagtagccaccatcataacgcccgtcaatcatcagtcccagtgatccgtaaaacaatcttaactagtcaacgagttccaagacaaccatttgtgcaccgtcgccacgacgaggcatagtcttgtaaattcgtgtgtaaccaccattgcggtcagcatattgaggacttaagtcactaaatagcttttgtcaatgcaatgcagtttgtacagccacgttgtcgccatcttccttaacatcggcaacgacgtcccgcatgaatgcggcagccttccgacgggcgcttaaatcacccttcttggccaaagagatcattttgtcagcagttgaacgaacttccttagcacgggcttcggtcgtctcgatcttgccgttaacgatcaatgacgttgtcaaatcgcgtaataaggcacgacgttgtgaacttgtacgttgtaatttacggtaactcatgaacggatatcctcccttgtattagtcttctttgcgtaatgataacccaaggtcagctaattttgccttaacttcctcgagtgacttgcgtccaaggttgcgaaccttcatcatatcagcttcagttttgttagttaattcttggaccgtgttgatgccagcacgcttcaagcaattgtatgaacggacggagagatctaactcttcaatcgtcatttctaacatcttttccttatgctcgtttcttccttctcgaccatcacatcagtgtttttagcttcatcagtgagatttacgaagattgaaaggtgatcagtcaggattttggctgatagactaatggcttcacttggagtgattgaaccatttgtccaaacgtctaaggttaacttatcgaaatcatcacgttgaccaacccgcgtgttttcaacttggtagttgacacgttcgattggagaatacaatgaatcaacagctaaaacgccaattggcatgtcatcttcacgatgtttgttatcctcagcggaaacataaccacgaccagtatttgcggtcatacgcatatggaagtgtgccccgtctgctacggtacaaattggtaagtctggattcaagacttctacgtccgcatcgccaatgatatcaccggcagtaacgttagcgggacccttaacgtcgatttccaacgtcttggtttcgtctgattccaacttaagtgcaatcttcttaacattcagagataattgctgtaacgtcttccgttacgccctcaatcgttgaaaattcatgaagaacaccatcaatttgaatactagtaacagcagcgccaggtaaagaagaaagaagaatccgacgaagtgaattccctaaagttgtaccataaccgcgttcaagcggttctacaacaaacttaccatagttgtcgttttcatcaattttatgaatgttaggtttttcaaattcaatcattcttatcttttacccctttcaaaacgcgtggtgtttagtagttgtgcgtacaaaatgaagtttgccctcaaaatgaacgtcacagattaaacacgacgacgctttggaggacgagaaccattgtgaggcactggcgtaacatcgcgaattgcgctaacttccaaaccagtagcttgtaaagcacggatagcggcttcacggcctgaaccaggacccttaacagcgacttcaacagtcttcataccatgttccattgatgccttagcaaagcagcttctgcagccatttgagcagcaaaaggtgttgacttacgactacctttgaaacctaatgaaccagctgatgaccatgcaatggcgttcccttgcatatcagtgatcataacaagtgtgttgttgaacgttgaatggatgtgagccacaccagattcaatgttcttctttacccgacgacgacgggttgtctttctagttgccataaaattcgaaaacctcctttattattattttttacgtccagcgatgctgacctttttacccttacgagtacgagcattgttcttcgtgtgttgaccacgaactggtaaaccacgacgatgacgcatgccacggtatgaaccgatttcttgcaataacttgatgtttaagctgacttcacgacgtaagtcaccttcagttttgtagccatcgacaacggcacggattttgtcttcctggtcaggagttaaatcacgtacacgaacgtcttctgaaacaccggcttcagcaaaggatcttctgtgcagaagtgttaccgataccgtagatataagtcaaaccaatgacaatacgcttgtcacgtggtaagtcaatcccttcaatacgagccattaatatttcacctccaacttaattaaattatttaccttggcgttgcttatgctttggattagcagagcagataatcatcacgcggcctttacgacgaataactttgcagtgttcgcacattggctttacagatggtcttactttcatgagttttttacctcctataaggtacgtagaccgagcctacttgaaacggtaggtaatccggcccttagttaaatcataaggtgacatttcaactgtaaccttgtcaccaggcagaattcgaatgtaatgcatccggatcttacctgatacgtgtgccaagatttcagcgtcgttttcaagttcaaccttaaacattgcgttcggcaacgtttctttaatggttccttgaatttcgatgacgtcttcctttgccaccaagtactgtccctccttattatcagattccgtgctaccacgtatttggtccattactgaaccagtcattgtctaatcataacattaaaaaaatattaaatcagtcaacggctaaacctgaataattttatcacaacgacctttgaaaagcaaacgtcgctgctgaaggaacctggtttacaggttatcaagaattttcttgatatctttgtagacatcatcaatgtcgcgatcaccgtcgacattgtagagtaacttttcttgaccgtaataatcaattaatggcgtgttcaacttaatgttcacgtctaaccgattcttaacggttgctggcttgtcatcatcacgttgatagaaatcatgaccgccacacacatcacaggttccttctaccttaggcttgttgtacaacttatggtaagttgcaccgcaagtccggcagataaaccgaccggaaagtcgttcaacaagtactgcgggttcaacatgaatgttgatgagcccccatcaagtggcttattgagttcttcaccgatttgtttcaaagcatgagcttgatcgatgttacgtgggtaaccatctaataggaaaccatttttagtatccgcttcagctaaccgatcacggacgatgccgttagtgacttcgtctggtactaagttacccgcatcaatatacttcttggcttccaagcccatcttcgtttcgttcttaatggctgcacggaagatatctccggtcgagatatgtggaatatcaaaatcttcaagaatcttctgtgcttgagtacccttaccggcacccggtaatcccattaaaatcaggttcattgttgacatgttttttcctcctgaatgcacaaatgtgttgagtctccccaacacattcgctgattaacgaatgaaaccgacatagtcacgtttcatcatcaatcctttaatttgacgaattgtttcaagggcaaccccaacaacgattagtaaactcgtcccacctaaaccccagattgattcatcgagaccccaaatatcagaagctaataatggaatcaaggaaatcaacccaaggtagagggcaccgaccgtacttagtcgcattaacaattttgaaacccaatcttgagtatccttacctggccaaacaccaggaatatagctgccttgcttttgtaagttcttagagagcttttcaggattgacctgaacaaacgcatagaagaacgtgaagagcacgatcagaatggtgtaaagaatagcaccagtcgtcgactgcatattgaagatattactcaaaacggtataccaggtttcgtcaccatgactggattggaaccctagcaaaatcgtttggggcgttgcaatgaaggaactcgcgaaaataacaggaataaccccggcaacgttcacctttaatggtaggtaactactgtcaggtgcaccagctgcacgacgagtgtattgaattggaattcggtcattagcttgttcgacccacgttacaaacgataacgatgatcagcacaagcaaggctaacccaacaacaaacaagccactcttccaccagtcgctctgtgaaacattaacgaactgttcttgataaatttgataaatcgatgttggcatacgggcaatgatcccggcgaagataataatggaaaccccattaccgattcctcgatccgtaatcatgtcacccatccaagtcgtcaacattgccccaccagtgaggatcaccccaatggtcaggtaagtcgaaatacttggattgttaacgagcttgagttgactcaaagagttaaaaccagccgtaatcccaatcgactgaacaaaggccaagacgatcgttaaccaacgggtcgcttgattaagcttgcgtcgaccaacttcaccttgtttgccccattcaacaaacttaggaacaatgtccatttgtaacaattgaacgatgatttgtgcagtaatgtaaggggatacccccatagcaaggatggaataatttgttaaaaaccgccaccactgaatgtattcaacatacttatcagccctgaagatgccaccgactgaagtgcctgtgcattaactccaggaactgtgatataagagccaagacgaaatacaatcaaaacgcccaacgtgaacagaagtttattccgaatatccttaactttgagagcgttcttcatggtagtcagcaaattagatcacctcagttttaccgccagcagcttcaatggctgcaaccgccgttgcagagaacttgcttgccttaactgttaactttttgttgagtttaccattaccaagaactttaacagcagaactcttcttaactaagccagcttcctttaatgattctggtgtaacttcggcaccatcatcaaaacggtttaagccgtcaaggttaacaaccgcatattctttacggttaatgttagtaaatccacgtttaggaatccgacggtacaatggcatttggccaccttcgaaaccgacacgaactttaccacgcgccttttgacctttttggccacgaccagaagtcttaccttggccacttgagtcaccacgaccaattcgacgacgtgaaaaacgtgaaccttcactaggtgttaattcatgtaacttcatttagtaggcacctcctctttgaaaatttgaattacttgatgatttcgacatcgactaagtgtgcgatgtggaaaatttgaccgcgagttgctgcgtcatcaggtttaacaacggaactattaatccgacccaaacctaattccttaacgattttacgttgcttaggaagacggtgagcagcactgcgtactaaagtgatctttaattgagccatgttgtttgtcctccctattcagctaaatgttcggctgaaacgccacgtaaagcagcgacttgttcagcagtctttaagctctttaagccttcgaacgttgcacgaacaacgttaacgggggtgtttgagcctaatcgtttactagtaacatcatcccacaccggctaattccatgacggcacgaacggcgccaccagcggcaacaccagaaccttcaacggctggcttaagcatgatgcggccaccaccgtaaacaccaagtgcttcatgaggaatggtggtaccaaccattggtacagtgatcaagttctttttagcagcttcggaagctttccgaattgcttctggaacttcttgagccttaccagtaccgaaaccaacgtgtcccttgtggtccccaacgattactaatgcagcaaaacgtaggcgacgaccacctttaacaactttggtaatccggttaatggcaacaacattatcgtcaagatctaattttgatggatcaatgaaagtcatatggtattattcctcctttgttagaatttaagtccgttttcacgagcggcttcagccaaagcttgaacccgaccatgatataagtaaccgccacgatcgaaaacgacgtcaacgattttcttttcagcagcgcgcttagccaacaacttcaccgacagatgcagccttttcagtcttgttgttacctttaacttcgctatctaaagttgaggcacttgcgagcgttacaccctctacatcatcaataacttgagcgtagatgtttttgtttgaacgataaacatttaagcgtgggcgctcagcagtcccagaaatcttaccgcgaacacgtgcgtgacgacgttgacgtgttttgtttttatctggtttggaaatcacaatagtcacctctatatattagtatggacagctttacgctgcattatttaccagtcttaccttccttacgacgaacatattcatcgacgtaacgaatccctttacctttgtaaggttcaggtgaacgaacggcccgaacttcggcagcaaagtcaccaacagcttgcttaccaataccagaaatattgatatgcgtgttatcaggaacttcaacagtcaagttttcaggcgttgcgaattcaacagggtgtgagtaaccaacgcttaatactaacttcttgccttgcaattgggcacggtaaccaacaccgaccaattgaaggttcttagtaaagcctttagtaaccccttcaaccatgttgttaacatttgcacgggtagtaccgtgtaatgccttcatcttgtagtcatcagatggacgagtgaatttaacttcgttgccttcaaccgtcatcgtaatatcactggcgatgttccgcgttaaagtacccttaggacccttaaccgtaacgacttcaccagcttgtgatacttctaccccagcgggtagttcaattactttataaccaatacgactcacttacttgcacctccgtcttaattaatgattaccaaacgtaagctaatacttcgccgccaagcttcttggcgcgagcttctttatcagtaatgacaccttctgaagttgagatgatagcaatccctaaaccgtttaaaaccttaggaacagcatcagccttgacgtatgaacgtaaacctggcttttgaaatacgcttcaagccactgattacacgttcgttgtccttaccatacttcaagaagacgcggatgatgccctgtttgtcatcatcgatgtattcaacgtcgcgaacaaaaccttcattctttaaaatttcagcaatgttgcgtttgatttttgatgcgggaacttctagtgaatcgtggcgtaccatgttagcgttacggatacgagtcaagaaatctgcgattggatcagtcatcatgaaagtttaacctcctttaacttgggtttgtttttaccagctggcctttttcataccagggatttgacctttgtgggccaggtcgcgtaagcagatacggcacaagtggaatttacggtaaactgaatgtggacgaccacaacgttcacaacgggtgtagttttgtacgttaaacttagcaccgcgcttttgtttagcaatttgtgatttttagccaacttcgattaacccccttcggttatttagcaaatggcatgccaaaattgagttaacaactcacgtgattcttcatcactatcagctgtcgtaacgattacaatgtctaaaccgcgaacacggttaacattatcatagttgatttctgggaagatcaattgttcacggacacccaatgtgtagttaccgcgaccatcaaatgaacgagtacttacaccatggaagtcacgaacacgtggtaatgaaacattgatcaacttgtccaagaagtcatacatacgttcgccacgtaagtcaaccttggcaccaattgccataccttcacgaagacggaaaccagcgatagatttctttgcccgggtaaccaatggtttttgaccggagatcaaagttaattcttcaactgcttcgtctaagtttttagcgttggtaactgcatcaccaacacccatgttcaaaacgatcttagccagcttaggcacttgcattactgaagtgtaattgaacttgtcaactaatgctggaacgatttctttttcatatttgagcttttaaacggttttccatgaaacttgcttcctcctttcagtcagtcttagttttctaagtctttaccagactttttagcgtaacggacacgcttgccatcttcacgacgaacacctaaacgtgtaggttcgttggttgatgggtcaaggtacataacgttagaagcatcgattggtgcttcgatgtccacgataccgccttgtgggttaacgttcgttggtttttggtgtttcttgatcttgttaacaccttcaacaacgatccggttcttggcagagataacctttttaacagtaccttcttgaccacgatccttaccgctgattactcgaactttatcaccagttttaatcaacattaggttgcgcacctccttatttacggtgtgtgactagagtacttctggcgctaatgaaacaatacgcatgaagtccttatcacgtaattcacgagcgacaggtccaaagatacgagtaccttgtggagtcttgtcatcaacgaataataactgcagcattttcatcaaacttgatgtatgaaccgtcagcacggtgaacaccagacttagtccggacgatcacagctttaacgacatcatgagctttgacaacaccaccgggtgttgcttgtttaaccgtagcaacaatgacatcaccaatgttagcagttttacgaccagagccacctaataccttaatagtaaggatttcacgggcaccggagttgtcagcaacttttaaacgactttcttgttggatcacagtaagtgtcctcccttcatgtaattttattcagctaataatctagataataacagctttttgaacaacttcaattaagcggaaacgcttagtagctgatagaggacgagtttccatgatcttgacgatatcgccagttttggcttcattcttttcatcatgagccttgaatttctttgaataacgaacacgtttgccgtataccggatggttcttgtaagtttcgacaataacacaacaatggttttgtccatcttgtcagaaacaacgcgtccttggataaccttacggctattacgagtatcttcactcattcgtgattgcctcctttatactctacttgtttaactcttgttcacgcaacgcagttttaatacgcgcaatgttcttacgaacttgttttaaacgagcggtgttttcaagctgaccagtggccaattgaaaacgcaagttgaaaagttcgtctttgtaagacttttctttttcgagcatttcagtagtggacaatgctttaatttccttagccttcatctgattcgccacctacttcctcacgcttaacaatcttagttttaacaggtaatttagttccagccaagcgtaaagcttcgcgtgcaacttcttctggaacaccagcaacttcaaacataatcttgttacgtttaactggtgctacccaacctgcaggagtacctttcccattacccatccggacaccgacacctttttcagtgtaggacttgtgagggaaaatcttaatccataccttaccgccacgcttcatgtaacggttcatagcaacacgggcagcttcaatctgccggttgctgatccagtgtgattcgagggtttgtaaaccgtaatcaccaaaagcaactgttttaccgcctttagcttcaccgcgcattttaccacgatgaacacgacgatacttaacccgtttaggtaccagcatgtttagtttcctcctttagcagatttcttttctggcaagatttcgccacggtagatccaggtcttaacacctaatttaccgtaagtcgtccgtgcttcgacccatgaatagtcgatgtcagcacgaagcgtatgcaatggaaccgtaccatctgagtatgcttcaacacgagacatgtcggcaccgtttaaacggccagcaacttgtgtcttaatacccttagcaccggaacgcattgtacgttgcatagcaccacgcatcgcacgacggaaagcaacccgggcccttccaattgacgcgcaatactttcaccaactaatttagcatctaaatcaggcttcttgatttcgatgatgttgatgtgtactcgcttaccagttaaattgtttaattctttacgaagagcttcaacttcagaaccacccttaccaataaccatccctggttttgcggtatggattgaaatgtttacgcggtttgcagcgcgttcgatttcaacggtggagacggaagcgtcggcaagtcgttgttcgatatacttacggatgcgtaaatcttcgttcaagtaggcagcaaaatcttttcagcgtaccattttgcttcccagtcgcgaatgattcctacacgtaatccggttggatttactttttgacccacgcgttatccctcctatttttcagtaactgtgatcgtaatgtggctagtccgcttgttgattggtgaagcagaaccctttgcccgtggacggaaccgttttaaggttggtccttcgttaacaaaagctttcgcttacgaccaaatcttcgcgatctaagtcaaagttattttcagcgttagcaacagcagaaagtaaaactttttctactactggagaagcaccccgtggagtgaacttcaagattgctaaggcttcggcaacacttttacctctgataagatcgacaactaggcggaccttacgagcggcaatacgaacagtttttgcagttgcacgtgcagatgttacttgttcagccattctttatatcctcctaactattacttcgttttcttatcgtcagttccatgaccatggaacgtccgtgttggtacaaattcacctaacttatgaccgaccatgtcgtcttggatgtaaactgggacatgcttgcgaccatcataaacagcgattgtgtacccgataaaacttgggaaaattgttgaacgacgtgaccacgtcttgatgacagatttcttgtcagaatcagattgtgcatcgattttctttaataaatgcgcatctggcgaaaggtcccttctttaaactacgacccatcgtgtgacctcctctcgataactacagtaaattcaaattttattagtgtttgcctggacggcgaccacgaacgataagcttgtttgaacgagccttcttgttccgagtcttcttaccaagcgtcttcttaccccatggagacattggagatggatgaccgattggtgctttaccttcaccaccaccatgagggtgatcgttagggttcattacagaaccacgaacagttgggcgcttaccttgccaacgtgtacgaccggctttacctgagttgattaattcgtgttgttcattaccaacagtaccaatagtagcacggctagttaataatactaaacgaacttcaccagaagacaaacgaacaattgcgtacttgccttccttacccagtaattgtgctgaagtaccagcagagcgagctaattggccacccttacctggcttcaattcaatgttgtgaataacagttaccaacagggatgttagttaatggtaatgcgttaccaaccttgatgtcggcttcggcacctgattgaacttgcataccaacttccaaaccttttggtgctaagatatatgatttcacaccgtcagcgtaaactaataatgcaatgttagctgtccggttaggatcatattcgattgccttaacggttgctggaacttcatccttaatccgcttaaagtcaaccaaacggtattgttgcttatgaccgccgccacgatgacgaacagtaatgtgaccataactgttacgaccggcagtgtgactttgtgagtctaataatgacttttcaggcttcgtcttagtgatttcagagaaatctgaagcagtcatattacgacggccgttagtggttggtttatacttcttaatacccactagagttacctcctaaattagatttattgttgatcgtcgttgaacaacttgatttcgttagaatcagaacttaaggtaacaatagaccccttacgacgcttcttagtgtagccggcgtaacgaccttggcgcttaagttttcctttaacgttcataacgttcactttaacgactttaacatcgaagatttcttcgattgctttttaacttgggttttcgttgcctgtacgttgacatcaaatgtgtagcgcttgtcgtccaagtcagccattgatgattcagtaactacaggacgtaaaattacatcgcgtgcttccattatgcgagcgcctcctctaattgatcgagggctttttgggtaacgactaatttgtcactattagcgacatctaagacgttaacacctttggctttaaggatcttaacatttggtaagttacgaccgccaaagcagccttttcattgtcctcttcaaccaaaacaagagtcttggtatcgacgttgaggttgtttaatacatttacaaaatccttagtctttggtgcgtcgaaagctaagctatcaactgcaactaagctgttgtctaagaaccttttgtgaaaggacagacttcaaagctaagcgcataaccttcttaggtaatttgtaactgtatgaacgaggggttggtccgaagacaatcccacctttacgccattgtggtgaacggatagaaccttgacgcgcacgaccagtacccttttgacgccatggtttacgaccaccaccgcgacgagcactacggttcttaactgcgtgagttccttgacgcattgatgcacgttgcatcaagatggcatcaaaaaccacgttttcgtttggttcaacaccaaacacagcgtcgttcaaagtaacgtcaccattttgcgtaccgtcttgtttaaataatgctacgctagtcatgtattatgtcctccttccttatttactcttaacagatgttttaactgttacaaatgacttgttggcgccagggacattccctttaattaataaaacgttgttttcaacgtcggcacgaacgatttgtaagttttgcatcgtacgttggtgattacccatccggcctggtaatttcttacctttgaatacccggttgatgatggcacccattgaaccaggacgacgatggtaacgagaaccgtgagccattggtccacgactttggccgtccttatggatattaccttggtaaccatgacctttagtgatacccgtaacgtcaacggcgtcgccagctgcgaaaatatccgctttgacttcgtcacctactgtgtaatctccaagctcaacattacgaatttcacgaatgaagcgcttaggagtcgtttttgcttttgctgcatgaccttgagcgggtttgttcgtcaagacttcgcgtttgtcgtcaacacctaattgaattgcttcgtaaccgtcattttcaacggtcttaacttgcaacacaacgttaggttgaacttcaacaactgtaacgggaactaattcgccgctttcagtgaagacttgcgtcattcctacctttttccctaagattcctttagtggtcatgagtacacctccaattaattgattttagtttagtaaattaaagcttgatttcaatatctacaccgctaggcaagtctaacttcattaatgagtcgaccgtcttaggcgttgggttaacgatatcgattaaccgcttgtgagtccgcatttcgaattgttcacgtgagtccttaaacttatgtggtgaacgtagaacggtataaatagtccgttcagtaggcaatggaataggacctgaaatagtagcaccagttctctttgccgtttcgacaatcttgtcagctgactgatcaagaatgcggtgttcgtatgcctttaagcgaatacgaattttttgctttgccattgttgtgacctccttcgtctattttgaaaataagactagctccgtgaaaattaccgccacgtcccatgacaatgtggccgggcgtgtcgcaacctttcacatcaaagctaactacgactacttgatgatggggatatagttatcccccttctaaataccaagcacaatctataataaatgaaaagctctgtaatagcaagtgttttcgcacttttttataaccatcgttgtaaaccgtgttaccttttgaaccagctcaattaatgtaacacaaattccatccaattaatagcgtttgcgcctaatttcttttggtgagcgctttacatttctcactgccgaccggccacgatcatgtggacacctactagattgcattaacactttctcaggaacaagacccgcgttcagcgtcatacatttttgtctggagtcatttaatcggacttcaacacgcttaattcaaccgctcctacatctgacggcgccgtcacactgacccacgttcttgttcatctaccttctattatattgtcatctgcttaccaccgaccgtcagcaccttggccgtggtcaccgacaaccgtcaactcatgtggttatctccggtacaaaaatgtgatgttgtccgcgttctccttattatgctatgagtctcgcaccctttaatattatggctgccagttttatggtcgcagcggctagtaacttaactagtgcgacccttgttgcgcgattgtacccttgcgcgatgacacaggcctgagcagcactgtgctcgtcacagccgtacccaatgccagtgacggccaaactatcccaagccgcttcaattgatgtgccacgttgtcttacgacgagcagtaatcacatttagttcgaccagaaatttatgtaaaaaagaacgtccagccgaagctgaacgtccttcttattatcaatcaagcttatttggcgggagtgccgccattcttcttgatgatatcttcttgaactgactttggtaccttttcgtaatgatcaaaggtcattgtgaaagtcccacgaccttgagtagctgaacgtaatgtggttgcataaccaaacatttcagccaaaggaacgtatgcatgaacttcttgggcattcccacgttcttccatacccttttcgatgttaccacgacgagcagtaacgtgacccataacatcacctaagtaatcttctggggcaacgatatcaaccttcatgataggttcaaggataacagggccagcagtcttaacggcattccgcaatgctaatgatgcggcaatcttgaaggctgcttcactagaatcgacatcatggtaagaaccatcatagagcttagccttaacgtcaaccaaaggataaccagctaacacaccgttagccatagcttccttcaaaccttgttcaactgaaggaatgtattcacgaggaacaaccccaccgacgatggcatcttcgaattcgaagcctttaccttcttcgttaggtgtaaattcaacccaaacatccccatattgacctttaccaccagattggtgaacaaacttaccttgaacttgagtgctcttagtaaaggtttcacggtatgaaacttgaggcgcaccaacagtggcttcaacattaaattcacgccgcatccggtcaacgatgatatccaaatgcaattcacccatcccggcgatcaaagtttcaccagtttcagggttagtttcagccttgaaagtaggatcttcttcagaaagcttttgtaaggcaacgttcatcttatcttggtcagccttagtcttaggttcaacggcaacctggataactgggtcagggaattccattgattccaagtgatatggatggtcaatcgaagtcaatgagtcaccagtagtcgtgttcttcaaaccaattgcagcggcgatatcaccagagaaaacttctgggatttctttccgttggttagaatgcatttgaagtaaacgaccaacccgttcacgtttgtccttagtggcgttcaagacatatgaaccagattccaaagtaccttggtatacccggatgaaagtcaaacgaccaacgaatgggtcagtagcaaccttaaatgctagggcagcgaatggcttatcatcaccggcaatcaagtcaacatcaactttcttcttcagtttcaggatcagtagccttgtatggcttaacatcaagtggtgatggtaagtagtccacaacggcatccattaacatttgaacacccttgttcttgaaggctgaaccagctaatactgggaagaattcaagtgctaacgttcctttacggatagcagccttaatttcttctttgctgatttcttcaccgccaaggtacttttccatgatgccgtcatcgatgtcagctaaggcttcgattaagtcatcacgtgcagcttgggcttcttctttgtattcatcaggaacgtcaaccgtatcccattcagtaccaagttgatcttcatcataaaggtcagccttcatttcgattaagtcaatgaccccttcgaaattatcttcggcaccaattggtaattggatggcgtgggcgttagcttgtaaacgatcatggatcgtgcttacagagtacttgaagtccgcaccaatcttgtccatcttgttaacgaaaaacgatccggggaacgttatacgttgatgcttgacgccaaactgtttcagtttgaggttcaacacctgattgggcatccaatacggcgatcgcaccatctaaaacccgaagtgaacgttcaacttcaacagtgaagtcaacgtgccctggggtatcgatgatgttaatccggtggttcttccactgtgcagtcgtggcagcagaggtaatggtgatcccacgttcttgttcttgggccatccagtccatttgtgaagcaccatcatgggtttcaccaattttgtgaattttaccagtgtagtacaagatccgttcagtagtcgtggtcttaccagcatcgatatgggccataataccaatattacgggtcttatcgagtgagaattctcgtgtattagccattagaaaatgtgttactcctctcaatataaatggaattaacagtataaagtttatttcaaaaaatgactactatatgcgcgcatataatagtcaccttttattgtgattagttaaaggcgacctttaaccatctcacggaaatattaccaacgataatgggcgaaggcacggttggcttcagccatccggtgagtatcttcacgcttcttaactgaagcaccagtattgttagcagcatccatgatttcacgagctaaccggtcggacatagtgtgttcgccacgtgagcgagcatattgaacgatccaacgaaggccaagagtcgtcttacgatctgggcgaacttcgattggaacttggtagttagaaccaccaacacggcgggccttaacttcaagtactggcataacgttcttcatagcttcttcgaagacttccaaaggatcgttaccagtttgttctttgatttgatcaaaagcatcatacaaaatagttgatgcggtaccgcgcttaccatctaacattaagtggttaattaaacgcgttactaatttagagttatacattggatctgctaaaacttcgcgttttgcgggtgcatccttttcttggcatttaacttacctccttattatttctttggcttcttggtaccatacttggaacggctttggcgacgatcttcgacaccagcagtatccaaagcaccacggataacatggtaacgaacaccaggtaaatccttaacacgaccaccacgaattaagacaacgctatgttcttggaggttatgaccaataccaggaatgtaagctgtaacttcgattaagttagataaacgtacacgggcatacttccgtaaagccgagttaggcttcttaggagtcatggtaccgacacgagtagcaaccccacgcttttgtggcgctgggttattagttgcaaccttcttgtaactgttatacccaaagtttaacgctggggcatttgattttgatactttagacttacggcctttgcgaattaattgattaattgttggcatgttctaaagtgtcctccttccaaatatctgtttttaagtccacacatccaggtggctttcttttttgagtaaaaagaatgcctggagcatggtaattgtgcgcttagccgaccagtcagcatgtctgtattcctgatacaggaatctgtctgcaaaaagcacctttactagactatcatgacatgccgaagttgtcaataaatgttctgaaaaaatagtgatgctttacattgcgtaactagtgatgaaaggtggtccttccatgttaaccagcagtctttttattattggtctctgtctgggctcattcgtgacctgtatggcggaacgcatcagcagcggacacatactcattagcactcaacgatcacggtgtccacactgtcgacatcaattacggttctggcaactgataccattactcggcattctgcttcaacgggggcagtgctatgattgtcgcactcctatcagcctccgttccagtctaattgaattactttgtggtggtctactagtttctagcagtgcgtcattgtcattgacgctgccactgcttgattagttacttggtattgattttcaatagtcttactgattatctcacttttgaagtctacccgctgacattacttcttccagccggactgggcttatggcaacaacggccacccctgacgatcagtctctacctcgtacttgccttactagtcgggttatacttgctggcccggctaactgccacctttggtctcggcgatgttgacgttctactcatgcttgtcttcatcattccagccgacacactgttgacctgtctcgccattgcggccgttgccgcattagttggttttatcatcagtgccccacgccatcgcttaccattcgtgcccttcatcagttggagcttcatcatggtcacccaactcacgggtctcgcatagcgagctataattgcaatattctagtacgcccgattattgcttgttagtcagtacgcgtcctgtgcggatgaacgaccactcaacttggtataatttgttgtcgaattgtttactactacttggaactttaaacaagcgttaatattgtatcagttgttctgaccctcagtagtaatatggtgatttagaaatcggggacagctcacaattctattattaacctgaaagttacccgataagattccggtctcaaaaaagtaacgactaatccgtcaaaagttgcgtacgcacgtgcccaccattcgaacaccatcccgagcggaagacgtttcttagcactgcaagagtgtccggtttagacgggctgagactgaggattagtgttagctaaccgaaagtctcattccaatctgaacacgtttcaccaatatagtattaaggcacggcagtccagcaattagcagaaatgcctggagcgcagtgcgggacacactaactaagcaagtttacacaaacttgaacttttccagtgaggctcagttagtcttctcccctgaagattaaccttcatcgccgaacgccccagatagcctacctacaatcgtgcatacaaaagggacgacacaatggccgccctttttagttacttagcaattacttgctagcatcttgttcttgcatttgtttttcaaggtcgctgattgagtaaaccccatcagccacgttgccaacttcctttggtttgatatgacggtaaaccggcataccagtcccagcaggaatgatcttaccaatgataacattttccttaagcccgatcagtggatcgttcttaccacgaatagcagcatcagttaagacccgtgtcgtttcctggaatgaagcagctgacaagaaactattcgtttcaagagcggctttagtaatcccaagaatgactggccgtgacgttgcgggaataccaccagcaatcaaggtcttgtagttctcgtccttgaagtctgcaatatccattaacgtcccaggcaagacgtcggtatcgcccggatccatgacccgaaccttccgtaacatttgccgaatcatgatttcaacgtgcttatcgccaatttccaaaccccttgcatccgataaaccttttgaacttcacggagcaagtagttttcagttgataagacatcacgcacttgaatcaattgtttaggatcgatcgacccaatgttcaacgcagcaccacggtgaataaagtcgccttcactaaccgccatccgtgctgttaacggcaacgtgtaagtccgggtatcagtttcacccttaaccgtaacttccttcgtccgttccgctggattttcttcaattaattcaaccgtcccagtaacttctgagatttcggcacgccctttaggattccgtgattccacaatttcttgcacacgaggcaacccttgggtaatatcgtccccggcaacaccaccggtatggaagttccgcatggttagctgagtaccgggttcaccgatagactgtgcggcaactgtcccaacagcttcaccaacttcaacttcatcaccagtagccatgttacggccgtaacaatgttcacaaaccccatgcttttagtgttgcaagtaaatgcagaacggatcgtaacttccgttacaccagcatcaacgattttatgagctaagtcttcgtcgatcaagacgttgttaccaacaatttcatcatgcgtttcaggatcaaagacagtcttcatcgtgtaacgacctaagatccggtcatacaacggttcgatgacttcgttaccttccatgattgcgtgaatccgcaacccacggtcagtcccacaatccttttcacgaacgataacatcttgagccacatcaaccagacgccgagtcaagtaacctgagttggcagtcttaagcgccgtatcggtcatccctttacgagcaccgtgggttgaaatgaacatttccaagacagacaaaccttcacggaagtttgaaaggattggtaattccatgatcttaccgttaggggcagccatcaaaccacgcatcccagctaactgagtaaagtttgaaatgttaccacgcgcaccagaatcactcatcataaagattgggttatccgcgttgaaactttcaatcagtttttgttggatttggtccttagcgtcgttccagacaccaatgacccgttcataacgttcgtcatcagtaattaaaccacgacggaactgttttgaaatcgtattaacttgtttatgggcttcggcgataattgctggtttttctttcaaaccagtaatatcggcaaccccaaccgtcaaaccagacttagttgaaatgttgtaacctaagtccttcatccggtcaagcaagagtgacgttgctgtcacgtgatattgcttgtaaacttcagcgataatgtcggccaagaagcccttcttgaatggtggaatgagttcctgggcatccaagaattgatgaatatcttcaccaggcttcaagaaatacttgtccggtgtaccagcaatcaagttatcgttagttggttcgttcaagtaagggaacttgccaggcaaaatgttgttgaagattgccttaccaaccgtcgtgactaagactgcttgcttctgatcgtccgtgaatggcttgtcaggcattgatgagacctgaatgccgacccggctatgcaaatgtacataacctgattggtaagccttttgcgcttcattcaagtccttgaagatcataccttcgccttcacgaccgatttcttcagtcgtcaagtagtagttaccgataaccatatcttgagatggcgtaacaacgggtttcccgtccttaggcgccaaaatatggtgggcagccaacattaagagccgtgcttcagcttgggcttcatctgaaagtgggacgtgaatagccatttggtccccatcgaaatcggcgttgtaagcttcacaagccaatggatggagccgcatcgctttaccactaaccaagacaggttcgaaagcttgaatccctaaacggtgaagcgtaggggcgcggttcaagagaacaggatgttccttgatgacgtcttccaacacaccccagagacatcgtcatcggcatgttcgatctttcgcttagcattcttgatgttagaagctaattcacgtttaaccaattccttcatgataaacggtttgaacaattccaacgccatttgacgtggcaagcccatttggttcatcttcaagaaaggcccaacatcgataaccgaacgaccagaatagtcaacccgcttaccaagtaagttttgacggaaccgcccttgcttccctttcaacatgtgtgaaagagacttcaatggccggttaccaggaccagcaacgggacggccacgacgaccattatcgatcaacgcatcaacggcttcttgcaacatccgcttttcgttttgcacgataatcccaggtgcatttaagtccaacaagcgtttcaaccggttattacggttgataacccgccggtacaagtcgttcaagtcagaggtggcaaaacgaccaccttccaattgaaccattggccgtaagtccggggaataaccggaattggcgtccattaccatccaagctggttcgttaccagatgtcacgaaagcttcgatgatatcaagccgccgaacggcccgggtccgcttctgaccagaagcatccttcagagtttcctttaaatcacgtgcttctttttcaagatccacgttattcaataaccgtttgatggcttcggcacccatggcagcttcaaattcgttaccatattgagccttcttctcacggtattcacgttcagaaagtaattgcttcttttcaagtggcgtattaccagattcgataacgacgtatgaagcgaagtaaatgatttcttcaagtgcccggggactcatgtctaagactaagcccatccggctaggaattcccttaaagtaccagatgtgagtaactggtgcggcaagttcgatatgacccatccgttcacgacggactttactacgagtcacttcgaccccacaacggtcacagacaatacccttataacgaatccgtttgtattttaccacaagcacattcccaatccttagtaggaccaaaaatccgttcgtcaaacagaccgtctttttcaggtttcaatgtccggtagttaatggtttctggctttttgacttcgccatatgaccagctgcgaatcttgtctggggatgccagaccgatttgcatgctttcaaacttgttgacatcgatcaaaggaccgacctccctttttattgattatcttgctgagcgttggttgtttcagaaggcttagcggcgtcagcttttgcggccttgtccgcagccttctcatcttgttgttgtttaaacttgctgagtgcatcgacattgacaacttcatcgtcatcatcatccatgtcccgcaattcgatttctttgtcttcagaatccaagactttcatgtcaagaccgagtgcttgcaattccttaaccaacacgcggaatgattccggtacgccaggctttggaattggttcgcccttaacgattgcttcataggtcctttaacccgaccaacaacgtcatcggacttgtaagtcaagatttcgcaaggtataagctgcaccataagcttccaaggcccaaacttccatttcaccgaaacgttggcccccaaattgcgctttcccaccaagtggttgttgcgtaaccaaagagtaaggtccgattgaacgagcatggatcttatcgtcaaccatgtgactaagcttcatgtagtgcatgaccccaacagcgacccgcttatcgaacggttcaccagtccgaccatcatagacgatcgacttggcatctgaatcaaccccagcttcacgaatggcttcccaaatatctgtatcttgagcaccatcaaagacaggcgttgccatgtgaattcctaacttccgagcagccatccccaaatgcaattcgagcacttgcccgatattcatacgagaaggcacacccattgggcttaacatgatatcgattggtgtcccatcaggcatgtacggcatgtcttctttttcaggaaccacgattgaaaccgtccctttgttaccatgccgaccggccatcttgtcaccaacttggatcttccgcttttgtgcgatgtagacccgaaccatcatgttaacgccaggagataattcatcaccgttttcacgagtgaagatcttaacgtcctggatgataccgccgccaccatgaggaacccggagtgacgtatcccgaacttcacgcgccttttcaccaaagatcgcatggagaagccgttcttcagctgacaattccgtaacccctttaggcgttaccttaccaaccaagatgtcaccgtctttaacttcggccccaatccggataatcccgtcttcgtcaaggttcttcaatgcatcttccccgacgttaggaatttcacgagtcatttcttcaggtccaagcttggtgtcacgtgcttctgattcatattcttcaatatgaattgacgtgtagacgtcttcacggactaaacgttcattaatatgatgattggcatcttcgaagttataaccattccaagtcatgaaggcaactaatgggttttgcccaagggctaattccccaccttccattgctggaccatcggctaagacttcatcgttatcaacgtgatcgccaactttaacgattggccgttggttatagttcttaccaccgttagaacgacggaatttcattaacttgtaagtgtctaatgaaccatcatcgcgacgaacgcgaacttcgcgagcatcaacgtattcaaccgttccttcatgacgacaaatcaaggcaatccctgagtcatgtgcagctttatattcaatcccagtcccaattaatggcgcgtgaggatcaagtaacggcaccgcttgtcgttgcatgttggcacccatcaaagcacggttagagtcatcgttttccaagaaaggaatacatgccgttgcgacggcaaccacttgtttaggcgaaacgtccatgtaatcgacattttcgattggcgtttccaagttttcttccttgttacgagctaaaacagtgtcttcaacgaaagaaccatcatcattcaatggagagttggcttgtgcaatcacaaattggtcttcttcatcggctgctaagtagtcgatcttatcggtaaccttatgcgttgtccaatcgacacgccggtatggcgtttcgatgaagccataacggttgaccttcgcataagaagacaaactgttgatcaaaccaatgttagggccttcaggcgtttcgattgggcacatccgaccgtagtgggtatagtgcacgtcacgaacttcatatccggcccgatcacgagtcaaaccaccaggtcctaaggctgataaacgccgcttatgcgttaattcacctaaggggttggtttggtccatgaattgtgacaattgtgatgacccaaagaattccttaattgaagcaaccactgggcgaatgttaatcaattgttgtggcgttaccgtcgcagcatcttgaatcgacatccaggttcacgcacaacccgttccatccgggataacccaatccggaattggttttgcaataattcacccacggaacgaatccgccggttacccaagtgatcaatatcatcggttgagccaagaccttcttgcaagttgaagaagtaattaatggaagcaatgatatcagcagcacaatgtgcttgaacttcaaatcaatgttgccattaccaatcacgttcacaaccttttcagggtcgttttgtgaataaaccttaacaacttgtaagaccattggattcgtaacaacggcttcgtcagatggtgtgtaagtaaccgtcttaaagtcgtcacgttccaagtatggggatagtttagccatgacattcttgtcaatgaccgtatccttttgcgcaataacttcaccagtatcaggatcagctaatgtctcagctaacgtttggtccattaagcgcgtcttcatgcttaacttcttgttaaccttgtagcgaccaactggtgtgcgaagtcataccgttttggatcgaagaaccgagcagtcaataggctccgcgaactgtcagccgtcttaggttcaccaggacgtagccgttcgtagatatcttttaaggattcttcaacccgggagtcgtcggtgttcttatgaacgtccttttccaacgtcaacatcaaactgtcagtttcacccaacatgtcaataatgtcatcgtcagaaccatatcctaaggcccggactaattccgtcaatggaattttccgcgtacggtcgatccgtacgtatgagacattcttggcgtcagtttcaagttctaaccaagcaccccggttaggaataaccgttgtgccgtagctaggacgcccatttttatctaattcttcattgaagtaaacgccgggtgaacgaaccaattgtgaaacaatgacccgttcggcaccgttgataataaacgtcccttgttcagtcattaatggaaaatcaccgaagaatacgtcttgcgacttaaatttcaccagtttcatggttagttaaacgtagggtaacgtgcaatggtgccgagtagttggcatcatgttcacgagcttcttcgacggtgtactttggttctaataattgatagtcgacaaattcaagtgaaagttttctgcgaaatcgtcgatcggcataatatcttcaaacatttcccggagaccttcatccaagaaccattggtaagaatcggtctggatttcgatcaagttaggcaaatcaagaacttccttgatacgtgcataacttctacgggtacggtgtttaccgtattttactaaatgtccggccaagttgttcaccccttcttattattccggaacccgccacctccggccaaatattacatttgtgttacaaatgcgtttttgaccgaattttaggcataaaaaaaccaaaaatagtcgcttaagttgactatttttggatttatattaacgagccgcacagacaatagattgcgcgttcgctcgagttcacggttacagacaagttataatatacatcgaataacgttagttgtcaactagtagacttctctgccgccattagttttctggttcactcgcaaccccgtataagatcatctttaaaagagtttgaacgcgggtccgctcgtcagcatgaggatcaccgatttgatgaaaactgttaaacagtggactcaagctggtgatatagaaattcgtcgccatctgtggtgtgacccccacatgtagttgcatgtcaggttgctcaaaaacggtttgaatcggcttcacataatcagtaacaaatatgccgcccaactcgcgaatatgttcatgcgttaatgctttgaaactggaatgaattaacgtgaagacatcagccggatgcttatgcgttagtaatagcgagacttctgttaattgatccaacggagaccaatccgcacggacttgaatcgcttcaatgccagccttgatttccgcaccgaccgtcgtaatgacagccagaaagatgacctctttatctttaaaatggtgataaagcgcgggctgcgtaatgccaatcgcattcgcaatgtcgcgcgtacttgtcgcatcatacccatttcttaaaaacagttcccgggctgtgtctaaaatcgcctggtgcgtcttcgccatctgttcggctcgtgtcgccatgttatcatcttctttcttgactttatttcctattataatttacaccaatcagcaccgaaccaccagcctcagatcctacagttcacttcagtgggtagcatcttaataccgattgaacctaaaagatgacgcctgaagtggactaccacttcaagcgtcatctttaatttaatcgcgcctactttgaggaaacggtcgaacgaccatctgccttaggctggtttttaatattaattgtaatggcacccttgctagcaccaatcgtaacttggtcatcgaccttgatcgcgccggtcaataattcttcactcaaccgatctttcgatttcagtctgtgatgcccgtcgaattggtcgtgctccgtactcagggtcaaagccagccttcgcaaccacgtcaatggcagccggagtgattttgatcttgataccttgttgggccactcgatcaacaatttcttgtgacatcaacttaacgatttcgtgtaattcttccttattcaatgaatggaagacgattgtttcgtcgatccggtttaagaattctgggcggaacgtctgttttaacgttgctcgaatcgtcgcagcaaccgcattgtagtcattggccttatcagttgcaccaaaaccaactgatttttcatcacgaagtgtggttgccccaaggttcgacgtcataatcagaatcgtatttctgaagtctaccttccgacccttagaatccgtcaagtagccgtcatccaaaacttgtaacaaaatgttaaagacgtccggatgagctttttcaacttcatcaaatagcacgaccgagtatggtttctggcgaaccttctctgtcagctgaccgccctcgtcataaccaacgtaaccaggtgccgagccaatcaaacgactagtcgaatagcgttccatgtattcagacatgtcgatccgaatcatattatcttcagacccgaacatcgctgctgccaaggcttttgctagctccgtcttaccaaccccagttggtcctaagaacataaaggaaccaattggccgactcggatctttcaacccgctgcgcgcacggcgaatagcacgagccactgcggatacggcttctggctgcccaacaacccgttcatgcaaaatcttttccaagttaactaagcgttcactttcagatttttgcaattgcgttaacggaaccccggtccattcggcaacgacctgagcaatatcctcacctgtgacttgtaaatcatagtgtggtgttgccccctcagtcacttcggcgtcttggtcagcttcgattcgatctaggcgttgcttcagttgcatctcccgcttacgaatatcagcggcctgttcaaaatcttgtgcttcgatcgctgtttccttatcctcacgcagttgcgctaacttgtcctggttcttggatagcttcgttggttgatccatctgatcgatgcggactttagctgccgcctcatccatcaagtcaatggccttatcaggcaagaaacgatcactgatataccggctggatagcttgactgcttgatcaacagcttcatccgtaatcgtaacccgatgatgttcttcatagcgtggccgtagtccatctaagatttcaacggcttcgtcttcggtcggttcattgaccatgaccgttgcaaaacgccgttccaacgcagcgtcagattcaatgtacttttgatactcatttaaagtggttgccccaatcgtttggagttcccctcgtgcaagtgcgggtttcagaatattagaggcatcaatagccccttcagcaccaccggcaccaatcaaggtatgcaattcatcgataaataagatcacatggccatcgttgtaaatttcatcaatcactttttttcaggcggtcttcgaattcaccacgatactttgtcccagcgactagtgaccccatatcgagcatcatcaagcgcttatctgccatatcagttggcacatcaccggccacaatcttttgggctagaccttcggcgattgcagtcttcccaaccccaggttcaccaatcaagaccggattattcttcgtccgccgtgacaggatctgaatgacccgtttgacttccttggaacgacctactaccgggtccatttcttgttcactagctaattgggtcaaatcgcgcgccagagaatccaaggttggcgttccttcagtcttcttgccaccgcgattagccgcgttacccttgcgcttactcatggcgtcactgacacctagcttgcgaagaacgactttacgcgtctgacctagatctaagtttaaattcattaaaattcgcgaggaaaaggatactttcatcagagagcatcgctaacaacaaatgttccgttccaatcttgttggcaccgagccgttttgcttcatcaccggcaacggacaaaatttctttggcctttggtgaatatggcaagtaagtatccttgccaacattgctcaacgtcccatagccagtgaaccgttcgatttcttcacgaatgtcatcttcactaacggcatattgttgtagcaccttattagcaattccattcttttcgatggccaatgctaatagcaaatgctccgtaccaactgcctgatgcttgaaatatttggcctgttcctgtgccagtaccagcacacttttggcactaggtgtaaataagttatccattgcgattcctcgctttctttagctttcgtaacgcaagtggttcaagattccgataattatccgggcccgcagactgttttctaagtcccggtccgttaatcctaacgtctcgtggtcaatcgccactaaaatcaattgcgcttctcgacgatttaagacgtcgtcctcgtataaactttggacgaccgcataagcatctcgttgtgtgattgaatcgccgatcacctgtatgagggcgtccaacacatcagcatcatcgaccaaattaaccttctcaatgcgaatataaccaccaccgccacgtttactttcaactaagtaaccattttggatcgtaaaccgggtcttaatcacataattaatctgtgagggtaccacgttgaaaaggtcggcaatttctgaccgtcgaatttcaacatgctccgagtccgccaaaatactttttaaatacttttcaataatatccgagatattttgactttgcatgtgcttcacccttttcattatctttgactaatattgactattattatacgaggataatggaaaaaagcaaagaatttcacccgaaccgcggactagcatgtgcttaacggttgttacagcatagcacgccaaacgtttgcttcttcaattgattcaaccgtttagaacctcataatgattaaattattaggtctccatattcattgaactacctatttagaatatgtcaagttgagtcactcctcattgcaggcgatgggcacttgtatcacaacgatgaacagcagttccgagactaatttctccgagctcatgactaacagtggctgttgccttgtcgggattatgagtcacaaccaccgtattcttcacatggctgacttagtgagtaacgtcgcaaaagtgtcccctgaccgttgaaacacccatgcttacaaaaaggtcataaaaaatccagccaaatgactggattagttggtttaaccgtaatcgggaaaacaggatttgaacccgcgacccctacgtcccgaacgtagtgctctaccaagctgagctacttcccgagaaaattaaataaaaagccttagcacttaactaagactgtgttaaacgatcgggaaaacaggattcgaacccgcgacccgcctggtcccaaaccaggtgctctaccaagctgagctatttcccgatactaatgcacccagtaggagtcgaacctacaaccttctgattcgtagtcagacactctatccaattgcgctatgggtgcttatttaaaatgccgaggaccgggatcgaaccggtacggttatcactaaccgcgaggattttaagtcctgtgcgtctgccaattccgccaccccggcaaattaaaagcggaagacgggattcgaacccgcgacccccaccatggcaaggtgatgttctaccactgaactacttccgcataataaagctattaaattgtaaatgccgactagaggattcgaacctccgacctcctcattactagtgagatgctctgccaactgagctaagtcggcatgtgcgggtgaagggactcgaaccccacgtcgtaagacactagaacctaaatctagcgcgtctgccagttccgccacacccgcatgatgttaatcatgccatatttgttgccggttcaaacagttcttactggtatgccttgacaactatttaactttatcatcatgttgaatacttgtcaacaactttttcaaataaatggataaatatactttttactggataaacaagttatatttttccgacaagaaatattatagcacggtagccgaaaatagcaaaccctattttcaaaaaaggtgaataaatttcagtaaacccagctttttcgcccttttgcgcctgaaatgttgtcccgacgttctgcccgtcccgcaattatttagtcaactcggccgttatttccactcacattttaaaatcgacagttccctttaatactcattaattatgcaaaaaaacgaactcgcatcactgcgagttcgctaacttcatctcaattaaccttgttttcaatcttcgtcttaccgtgcatatatggaactaatacatctggaatcgtaaccgtcccatcttcattttgatagttttccaaaatagctgcaacggtccgaccgacagctaagccactcccgttcaaagtatgaacgaattgcaatttgccatcgtcatcgcgatattgaatgtgcgcccgccgagcttggaaatcagtacaatttgaacaactcgagatttcccggtacttgtcttgttctgggaaccaaacttccaagtcatgtgtcatggcagctgtgaagctcatgtcaccagtcgttaacgtaataacgtgatatggtaacccaagtttctttagcaatgattcggcattgttggtcaacttctctaattcatcccatgaatcttctggtttcgtgaacttaaccatttcaaccttattgaattggtgtaagcgaatcaagcctttcgtatcacgaccagcactaccagcttcttcacggaaggctggtgataaggccgtaaagtaaactggtaatttttcagcgggaataacttcatcacgataatagttgactaatggcacctcggccgttggaatcaacaacgtcgtcaaatcttgcgtcgtaatccggaaagcgtcttccttgaacttaggaaattggccggtaccgtacatagattcatcagtgaccatgtatggcggcaaaacttccgtatacccttcagcttcgtgctggtctaagaaaaagttgtaaacggcgcgttccagtttagcaccatcgcccacgtagtataagaaacgactaccagaaaccttagcaccgcgctcaaagtctaagatgcctaaatcttcaccgatatcccaatgtgctttcggcgtaaagtcaaaatgccgtggtgtcccgattcgacgtaattcaacggcatcttcttctttcaagctaactggtacgtcgggatggggcatgtttggtaaatgtgcagccatatcctgaacttgggcatcgactgtccgccgttcttcatccaacgtcttcacatcggcgctaaccttttgcatttctgcaatttcggcactagcgtcttccttgttccgcttcttctgtgaaaatttcgcctgaaacttggttacgcgtcgacttcaattgttcgctcttggcgatcaattcacgacgcttttcatcagcggccaataaatcatcgatgtcactcgcagcaacgccccgatgaccaagctgttcttttacaaaatctggattttgacgaatcattttaacatctaacataacgacgtctccttttcacttttaatcgtaaataaaaacagtctctcctcccaattgggacgaagagactgcgattcgcggtaccacccaagttcaggatcatgattaatcccacccttaaacggataacggccgtgccgtgcagtattacccgcccacattgtcgcgccggagtttcgactaccgattcacaccacccaccggttctctgaacgtctacttaaaaacgcgccgtgtttaatattcactgtctactataaaacattgattctaaaaaggcaactagcctaaactagccactttttcgtcgatcaaccgaatcactgacttccttacgcgcatccgcatcggcgacaaagtccagctgatccccgtcgatctgcatcttcgggctatgatcataattagcgtaccagtcgtcatagcgttcattcaaagtctgataatatttatataaatcaggatcttgatcaatttgttcgtaagaacggccccgcttttggattcgtttgagcatcgtatcaaaagaaatattgatatgaataagtaaatcaggactcttttgatgagacgcttctggcaattccgcatcatgttatctaataatgaatcataaatgtcaacttcggtattcgtcgcccggccaagatcaccattcaaatgaaataataatgaatcttcaaaaatcgaccggtctaagacgtccagatcgttagcaaaagctgatttaatactgtctaaccgtttatttaaaaaatagatttgtaataagaaggcgtacttcttaggatccttataaaataacggcaaaatgggattatcaatcaactgactcgtaaaacgctttagaaccaaagtggttagccactaactgcgttaaactcgtcttgccggcaccgattgttcctgacattacaagcatggggcgtctctccttttaatcacgtcaaaattttgattatctctaaaagcaacactacatattgtacgcacccacgtcttaaaatgcaatatctggtgagtcaattcagtgaaaaacttcgcaccagccacaactgcgacgcactagtcagcgatccaagcaactcactaacacacactgggttactacccaagccggcgctggtggcacttcagctttgagtgcggcctctgaccagcataatctgtcgtgaccaaataatactcagttgagacgaacccacattgctaaaccgaagacaatttaaaagcgcacgctagctaattcctaacgtacgccataaatggtattaattggggccatcaataatacggctagcttattacttggccgccttttctgcgagcttgcagcaaactgacgtactgttcgagagtcaaattgtgcttagtcatgaattccgcactcgccttaccaacgtaacggaaatgccaagattcatagtcaatcccggtcgactgcttaccatctttagtaaagcgcaacacaaatccatagtccgccgcgtgattaatcaaccactgctgacccttgttcttgtcggatgatgacaataattgattaccatgagtgctgtaccagtgcgtgttcatgatatctgctgcgagaccagtttcatgctcactaccactaggaactgcgacatattctttagtcagctttaaggcttccttggctgattttccttgattctcataggtttgaatcgactgatcccaaacctctttttgataagcgactgaacgatacccagacacgattgttgctggatagccggctttttttgcccccgctagaaaggcttccaatggtttgacgatagaactacggacttcaataccatccacgctcgacttattaaatgtcatctcagcgcgcttatgccacttattgacgaccactaagtcgctatcggtcgatttaacgtctttcggtaaggcactaatcagtcgttgccgcttggtctgcgtcttcgtcgacttagcactcgtagaactactagtcgctttagacgtcgactggctagcaccacagccagccaggacaccgctaatgacactaatgctagacctcttaacaaatttctctttaacatctctctcgctgcctttctcatttcagcttagcatagtcatagccgactagcctattcctaaggataagtttgcgaatttttaatgattccatattctcattctatcaaattaccatagatatcagattagcgcaccctcaatttgccgcttgctatcattacaatcgtgcaagcccccactcataacgacccgccgtgaccatctgttgcgagcagtgttatcagcataaatcaggacacctaaaaaaatacgaccgcgccttgagttgacaggtccaactctcgccgtcaaaaatgcgattgacccagtgtcaaccgcatttaatcaaactatcaaagtgcgtgcttaatcttgatggtgtcgtttgcgtgtcaaatcaaccttgtctagcggaatcatcttagtatgatagcgaatcttataatagacatacaagatgatgaataacgggatgctcatataggtcaccccaatagccgccaatcaagcgttgcaaatgaatgtaagtcttgaccaataatgaccacgacacacaagataaaggcgaaccacgggccaaatgggaaccacttggcatggtaccgcaattcactcaattgatgcccccgcttaacaaacgcgcgacggaaacgcagatgcgaaatagcgattcctagccaagcgataaaacccgttaacccactggccgaaacgaggaaaatataaatccgttcaccgaatagactcgacaagaacgtgagtaaatccaatcaccgtcgttcctaataatgccatgattggaatcccacgacgattgacccgaccaaatgtcttgggggcataaccctgtaatgacaaagaatataacatccgtgtcgaggcgtacatccccgaattagcagctgacaatacggacgtcaagatcactgcgttcatcacactggccgcagccgccaacccagcccgtttaaagactaacgtgaacggactgatggcaatatcgctcgctgatgaccctagaagatctttcgacgtataaggaataatcgccgcaatcacgaaaatggctaaaatgtaaaataacaaaatacgccagaaaacttgtttaatagccgccggaatacttttctccggtgttgctgactccccggccgtgatcccaattaattcggttccttgaaacgaaaaaccagcgaccacgaagacactcaaaatcgttggaattccaccgacaaatggtgcctttttataagtaaagttactaagaggaggccagtggcatgaccgcccatgattcccacgatcgtcaagacaccgataaccaagaatacgagcacggtcaccactttaattagcgaaagccagtactcagtttctccaaacgaccggactgacagcgcgttgatcgtaaaaatcaaaacgagcgcaatcagactaaaaacccaccccggcacggatggcaaccagaactgcatgacaatcgccgccgtactaatatcgaccgctaacgtgattgcccagttgaaccagtaattccagcccatcgcaaacccaagtgccgggtcaacaaacttcgtggcatacgtggaaaacgaacctgaaacgggcaaataagttgccatttcgcccagactagtcattaaaaagtaaaccatcactccaataccaacgtaggccagtaatgctcccctggcccagccgttgaaattgccgaaccggacgcgacaaacagcccggtcccgatactaccacctaatgcaatcatggataaatgccgcgtctgtaaggaacgatgcacttcctgatgttgtttttctgccattgcagaacctccaaaaatcgatttatatctaaaagtgttcacaccgattcaggttagcacaatcaaaataaaaagcctctttgcctcacgataacgtgcgcaaaaagactttaatcagattgattgacataattgctgatttcatcgtcgatagcgccccgcaactattctagctgcgacagtccttgatttattcaaccaaggcccaacggatgaatcggtcactgatccatcgatttcggcggttgccccgttcactgaccttcataagtggtgacccacttccagccggctactattgttaaccgcatcctcttctttcgatatactcaaccattatatctgaccgaccatcttttgacaaccggtcactaatgttaattttaataaaactggtctggtaacattgtcttacctaacgccttgttatcagaataatcaattgactgaatatccaccacaactggaccatccgtggcaaaggcctgatcaagcactttttccaaatcagcgggttggtttacccgcaagccagtcgcaccaaagctttcagcatacttcacaaaatcaactgggccaaagtggaccgctgcatcctcgccatacttcatttcttcttggaatttaaccatatcgtaggtgccatcattccagatcaaatgaacgatattttgcttcagtcgaacagccgtttccagctcttgggcggaaaataggaaaccaccatcaccagagacagatacgatttgcgtatctggacgaaccaaagccgctgcgattgcccaaggtaaggccacccctagcgtttgcatcccattactgaacaacaagtgccgtggttcatagctccgaaagtgacgcgccatccagatataatgactgccgacatcgaccgtcactgtcatgtcatcactgacccgttgttgtaaggctgcaattactgacattgcggatgatttaacttggactgcttatcaatattaggtacgaaatcacgcgtctgaagccgttcttgtaattcacccaagtaagctcgcgcactatcgctaatatcatagcccttcatgtacggcaacaaaaagtctaacgtctgggcaatatcaccgatcaattcggtttccggttgaaaattatgatcaatttcagcgcgcattgcatcgataaccacgatacgggatttgccttccgcattccagttgcggggttcatattcaatcgggtcataaccgaccgcaatcactaagtcggacttctttagtaacatgtccccggttggttacggaataacccgacccgaccgaagaaatggttggcttccaaatcacgtgaaatcacgccggccgcttggaaagtctcgacaactggtagattagcagcagccaccaagttccgaattgctttcgtcacttctggtgaagaagcccgcatcccaactagcaagaccggacaacttagctgctttgatttttgtgctaataacgtggcttcgaccgggctagcgaggccctaacttaggtgcttggattggtgtaataacaggtgtgcgcacaatcgaatcagtgacatcttgtggcacactaacaaagctggcaccccgcttagcagctgtggcttcttggtaggcgtttgcgagcacttccgaaatattttccggttcttgaacttccgcactgtactttgtaatcggcttaaatagtgccgcgttattcatactttggtgggtcaaccgtaacaagtcagcacgctgaacttgaccagaaattgccaagactgggtcaccttcagcagttgccgttacgagccccgtggctaaattgctggcaccggggccagatgttgtcatcactacaccaggtttcccagtaatccgaccgattccggcagcgataaacgcggcattctgttcatgccgcgtcacgatcaaccgcggacttttcgggttgactgggtgctccaagcgctcaaagacccgatcgatcttagcgcctggaatcccgaatacgtacttaacgtcgtggtttacaaggctgtcgacgatcgcatcggccccgtaatatttcttatctggcatgttgttcccctctatcttgtgaaattcattgttagaataccataaaaaacgctttaataacagcattttcagccttgtgaaataaagtgtatcattttgaaaatgatccccgattggcaaaagcgcgtcaatattggtttaccaagcgaaaccgctcccaatttttatcgagtttgtacgacgtctcacttatgtgcccgcatccgactaagcaacgcatttaattgggccattttatcatctgagtaattcgtccaatccaacactgggatttgagtaacaactaataattccttgatcaacgtcgccagtttttgctggtctaaaaaatctaaccataattgatccgctcgcgaaaaatcccgttgaccactttcgcgtcccttcatgagcgaccggttcaacgtccttaaatactcggtcaaaataaccataattcggaaaggtctgcaacgtcccctcgatggccgcgaccacatctgtaattgaaatgtcctcaggtgagcgtgccaagtggacacccccgttatttccactggtggacgtgaccagtcccgccactactaatttacgaataatcttacgaatatacgaagcggaaccaccaattcgctcgtgcaagacatccgcagtcaacggaatctccggttgctgtgtagccaacaataccaacacgcaggcggcctgttcaaacgattttgcgagttgcattaactcacctcctaaaggtttaattccacacaatcaaagaataactccgtctgaccagcgccaaacggggcgtaatctggatggcgaacagcatcatactgtcgaaaattagcatgctctaagattcgcttagacgccggattattagctagacaactggctgtgatccgccgcaaatgaagcgtttcaaacccgtatcgtaaaatacgtgcaactgctgccgtcataatgccccgcccccaatatcgagcgttcaacatatacccgagatccatctctaaagttgctggttcgcccgtattcgtcatgcgctcatacaaccccacactgccaatcacgcggtggatcgctgttagttcaatcgcaaaaatctgtggtaacttcgcttgctgtttcaataagaattcggcttccactaagctgtgcgctggcgtaaagcccgccgatgccgcaattgacggatcacgaactaagtcataataatcctctgtatctgccaacgtaaatggccgtaactcgagttgctcattccgagttgtaaccgtaaccatgcccatatctgttccacctgacttgcgttataatagttatgttaaccatatcaaattgaggtgattgcatgcaagttattaagcaaaaattaacagcgacgtgcgcgcaattgaccgcctgggttatttgcatcaaccggatacgaacgcacaccaaacgaacttacccgccattattatcgttccgggcggctcatacacgcatattccagtggcacaagcagagagtctcgccatggctttcgctgggcacggttaccaggccttttacttggaatatacgctactcactgatcaacaaccactcggattagcacccgtattagatttaggacgagcagtcaacttgcttcgtcaacacgcggccgaatggcatattgatccgcaacagatcacgcccgctggttttagcgtgggtggtcacattgtggcactgtataacgattactgggcgacccgcgtggcaactgaattaaacgtaacgcccgccatgttaaagccgaataacgtggtactcggctatccagtcatcagtccattgctaggttttcccaaggatgacgcgaccttggctacctggacaccaacgccgaacgaactggccgctgaccaacacgtccaattcagataatcagccgacttttatctggacaacggctgacgacccaattgttccagcaaccaatacgcttgcctacgcgactgcgttagcaactgctaagattccttatgaactacacgtctttaaacatggcccacacggactagcccttgcgaatgcacaaacagcatggaaaccagacgccaatcagccgcacgtcgcccactggttaacgttagcacttgaatggctagctgataatcgttagttcattaccagtcgttgctagttaatattttatagctgtaaacaaaaaatcgtttgcttcgatcaatttctcgcaatcagccgagtagtgtcgattaaagcaaacgattttttattttgagtctattatttagtgacacggttgcctgctaaataatagattagtttaagtttgttaattgtctttataaatatgagcgataaaacaacggccatttcaataatcctggtgcccagaaaacgtagaaccattgcatgatttgactccaagaccatgccaatagcacggccccaatcgtatcagttggataatgtgcattcaagtaaatacgtgagaaaatgaccaatactaaccatacgacactcacccacttgacgatcattgccattcgataacttggcaactcaggaacaatcaacatgataatcacgctgaccaacacgaaggttcctaaaacgtgaccactgggataactatatccggtatcccgcgctaaatgaccaattggtcgcgctcggccgatgatgtgcttgacaataaagcctaacgccattgcaccaaccatatatgctagcgtccagaacgcttgaatcttatatttaaatccgtacattagaaacgccaggatgacgatccacaaaatgtccattccgggtgacgccaaccaagcaatcaccttataaaataccgtccaaataccgctattactaatttggaccagcgacgttaaggccacatctagtaaatcaatcaataaccaaccgcgccgtcactaataaaatagcttaagtaggcaaataaaattaccccaatgacaaacttgatcggccgactacgcgacttatcgatcatcaaaacaagaacccccatttaatattaaaattaacaaaattataccatagtctattaatcgactgaacgaatcattaatatctctcagggaaccttaaaaaaaaaacaaagaattcccattttaatcacgttttattaacaaaaaggttatgatttatctgacagtcatcggtaatcaagctaaatcttacgtggattcagttcccgctgacccgaaaaatgctaaactatgaataactattaccattggaggaagagttcatggaagacatgccaagtcgctcagaaatgcatcgtgagaaatcacaaggaaacaattcacaggggaacggcaacgggcccaagaagaagcaccccgttcgcaataccgttttaatcattattgccgtgttattagttgggacccggggcctttgccgcgcgaacttattttaacgccaagaatgcggccgacaccgtcttcaagagtagtggtattaaaaagagtcggaatacgagcgccgtattgaatggcaagaaacccgtctcgatcctattactcggaactgataccggggccctcgggcggaactataaaggccggaccgatacgatcatcttagcaacgatcaaccccaagactaagacaacgaccctgatgagtttaccacgtgattctgaagtagctgtctccggcttcgaacaggacttcccgactaagttaaacgctgcctacgcttatggtagtgccggaacgaccatcaagaccgttcaaaaatggttgaacgttccaatcgactattacgccctgatcaacatgggtggcatgaaaaaagttgtggatgaaatcggtggcgttgacattactccaattcggacatttacctacgaaggttacacctttactaagggccaaaaagaacatatgaatggtgccaaagccttggcctattcccggatgcgttatgatgatccactcggcgactatggtcggcaacagcggcaacggcaattaatcaccgccattatcggagaaagcgccagtgcttccaacttgcttaaacaagatttcttaaattcacttgctaaacaaacacggactgacttaacattcggtaatttaactagtatcgtcactaattaccgtagtgcaaccaagaatatcgtctctgatcacgcccagggtactggtaagatgattgatggtcagtctttcgaagttgtttcgcaatctgaaaagcaacgggtcacgaacgtcttacgtaagtcccttaatttaaaggctgcgacaaccggcgaaaaatttgctaaccaaaactaaccatctgatttgatgataagagtcgtgactacttgttgcgatgtctcagctaactaattaaaaagcgccaactgaactgcttagtagagcagttcagttggcgctttttctgtattgaatgcgagtcgtaataactaatctaagcgcgtaactattcagaacgctggtacacggcaaattagtcgcactaacccaccacttttggcggaatttatttatggcgcttagtcttagcgtccgcaaactttgttcacgattcacaactaatcagccaacagttaggttacgactccaatcggtgcaaccgccactggcgaatacaaaatgcgataagccggttgagtaattcagctaataagaatcccaatgcaatcgcaccagtaatcataatcacttgcaacgtgaatgaaaccgcctcacgataattacccagcgcaaagttacgcaccatctgataagcctgactgccgggcacgaatgaaactaaactcggaatattgaagataatagcgggcatcttcttgtagcgagctgctaagctgctgaggacgccaataccgaccgagccaattaagcttcctaagacgaccccaccatcaaaagcctgaacaatcaaatagccaccccacgttagggtaccaatccagcccgcaacgtttaacgcttgatgcggaatattaataatcaggccaaaccccagtaccgcaatgtaagccagcactaattgtccaattgtgcccatcatgatccctccgaatacccaggctagtgcccgtacttaaaataatgtaatgacaacggcgatcccaaagcctagtgctgccgcactcagcatcgcttccacgccacgtgcggcccactgacgaaattaccagccagagtatctcgtacggcgtttgttaatggcactccgggcactagtggcatcaacgacccgataataatatcattgacattggttccccacccaatctgacacacccattccgcgccaaacccaattagaagtgccgccgttaactcgctcaaaaatttaattttaagataccggttaagcagataaaagaccaagtaacctaatgttccaataataacagttggccacgtattaacaatttcctgacgaaacataatcatcaaggggccactgactaaggctgcaccgaccaactgcaaccacaacggaaatgagcgcgaagctgcatctaactgattaagccgttgatataaagttggtaaatcaatggtcgtagccgcaaattcacgggataactgattgacctgtgccactttttcaagatcgatcgttcgctggttaaccgcggcaatctgcgttgcattacgtccttgaatcgacatcatgacacccgtaatcgtcacgtaggtattggcagcaacaacccccgcattctgagcaatccgcatcatcgtatcatctactcgcgaaatctccgaaccattctcgaccatgattttaccagccttcaagcaagtcgcaataatcatctcatcggttgtcactgtcatcccaccctttaataatcagaattacattctctaataattcttactttagccaatgtctggctgttagtaaagagctttatttatgataattaagcatccgctgcaaaacgacaaaaaaccggtgatgagaattaattctcatcaccggtttaagccatttaagctgttaattatgcttttgtaacgttaactgcttgtgggccacgatcgctttcttcaacgtcgaagtttacagcttggccttcatcaagactcttgaagccgtcttcttggatagctgagaaatgtacgaatacatcgctaccgttttcgcgagtgataaaaccaaaacccttatcagcgttgaaccatttaactgttccgtgttccataataaaaaatcctcctagtgcattttgcacgtataaaataatgtaaatcatgattcggtacaaatggggatagtttattgaaacgatctgaccaaaattacctaaccaagctacaagaacaattgtagcatattgtttctaaaaagggtagccaaacaccatgatttccatgaaatgtttatgtgatgataaatgaaacagaaataactaactaacaattaacaggtttgttcggaaataggcgccgcatgcttactttacaaagacattgtgcgccgctttatagctaactgggatttcctcgcccgttttctgaatggaaacggtaacagggccttcaaatggatcgtgctttaaaaccgtgaccgctgtccaatcttgagcggtgtatcatgcaaataaactaataaatcatgattatcaataaatcgctcaatcgtaaccgttgtgccatcccgcgtatctgctaaactcacatgactgtcttcctgataatgaccatccttatcgggaatcgcgccaccatgcgggcaatgcgtcggattgcctaaaaaggcttccaaagaatccactagtcgttcactggtcacatgctccagtacttccgcttccgtatgcacgtctggcaaatcataatccaatttatcaactaagaaatcttcccagattcggtgcttgcgaactaacgtttcagcgtagcgaatgcctttctttgttaacgaaatcccagcatacggggtatgcttagccaagccttcctgaactaatttaccgaccatctccgttacagagccggccgcgatgtctaaacttaaggcaatttgcttattcgacacctttttttcgtaccaccaagctcgaaaataatttttaagtaatcttccttcatgggggtcatgaatattcttcacctcaactaaatagttacttctgattctctctaatataattctaacatcttactacaattgagacaccagttctagtctctaataacgacaaagctttgaaataattgcctaatcgtgacataattaattgtagcgcaaaataaccaatttggttactaatttagaaacgtgcttgttcaactaaggaggaaccgcatcgtgaatgatgatgctcaattatcaattacgcaattggatagttctttgcagcacaaggcagttgaagactttgccgcattctacttaccactttttgacgctaacaaccttgaaatgatgtccaactatgatgttgccagctatatgacagacatcaatgaacaccttacttacggccgctacatgaccaaggctcagcgcttgagtgacaccgttaatttttcatttaccgcctacgtcaacttgattgatcgactcgatcaacaatactttactagtggtaatccagcactaccatggaatgaatggttagccgccaagtttgctcaaactgcgacatcttaacaattcctacttaattaacgcgcgctactcgtgattatttcatatagaagtagaattaatactaaatgaaagacaagcaccacgcgtacttatagattatttaaagagattgagttgatactcggtctctttttgttgataaccacactgatagattacgttttaacgtacgaaagtacaaaaagccccaagctttcccgcagcacttgggacctctggtaaatatcatcaccgggcgattgaagactactactagtttcaattacacgttgttttatgcacgattactacctagttctagctaggcatctctcagcgcttattcgcgctccgttgtaaatccttttgcaaagttaaacttcaaaacacgaccaacatgacaacggtcaacccagccataagatcggttgacgaacggaaaacttaaatgcccaagtgacttaccgacatttaccaacttaaatttaacattaattaatcggttacacaagctgaaggttgctagcgctctgacttaacgggataaagtcgataatgtggcgtctcatcttgaatataacaataaagctgttgtgtcttcgcttcgtcaaaatatcccaacttgaccatgtggtgaccatccgttcttcgattccttgaaaagccgtcatcataaagatgcgcatcatttccatttggttattatacccatcggcccgctcgacagccgctgccagtgtaaaaccctcgtctaacatcatctcttgataaaatgaacacgcatcagcataccatacgaataacgatgcgtggtattcttctcactcactttaagactatgaatataatttttctgttcccagtaacgtagctgtgtctgagagacgccggtcatcttcgccaaatcgctaattctgattgtgaattgatgcttacccagctgttctttaaatttcttaaaaatacaccgtcttcttgcttatccacgggtcaacctcttttctaacattttcaatactcagtatattatttttaatattaatgtcaagcttgttgacaaagtcgataaatccgattatattagacaacgtacttttttagagagaagggatttacttgtcaactcctgttgatacgcatgggaagccttataaccgtggcttgctcattgcagttttattagttggtactttttgtaccgttcttaatcaaacgattttaaccactgccttcccaacgttgatgaaagatttcgacatcacacaacgtcgaccgtgcaatggttaacaaccgggtttatgttagtcaacgggattatgattcccgttagtgcgtggttaagttcacggatttccactaaatggttatatctttccgcaatggccattttcgaagtgggtactattatctgttggacagcaccaaactttggcttcttattggctgggcgtttgatccaagccgttggggtcggggtcaccatgccattacttcaaacgattatgctatctatcttccccgctgataagcgtggggctgccatggggactgccggaattgttatcggtttagccccagccatcggtccaaccttatctgggtgggttatcgacaacttatcatggcgtgatttatttggtttgatcgttccaatcgtcgcaatcgttctaatcgctggcttcttcttcatggccaatgtcttggaaacgtctaagccaaaattagactttgcatccttggtactttctaccattggtttttggggagcttactatacggcttttcatccgttggtgacaatggctggacgtcaaccgtggttctctcaactttaattattggtgttatcttcatcattggttttatttggcgtcaattgacgatggaaaatccattcctccaattacgggtcttcaagcatgccgagttcacaattgcagctattttgagctcagttgctaacatggccatggtaggggccgaaatggttattccactttacccgcaaattattcatggtttctccgcctttgaatctgggctatcactattagctggtgccctaatgatgggggttatgagtccaattaccggccgggcctttgaccgttttggtgccaaacgcttggcaattttagggatgttcttactgacaatcgggaccattccatttgccttcattactcgtaatactgcaacggtttacatcgtggttctctatgccgttcggatgtttgggattgccatggtcatgatgcctggcaactaccgctgggatgaacgcccttcccgttgaattaatgggtcatgggactgccgttaacaacacgacgcgtcaaatcgctagttccattgggactgccatcttgacttccgttttatcaaacgttacggacgccacaaaaccagctcacagcttgattaagagcaatccacttggttatcagaacagctatttcaacgcaaccttaaatggttaccacgcggctttctgggttgccgtgggcttctcagttgtcgggctcgtcgtagcgttcttcatgaaaggcaagcagcattccgttaagccagtaatgaacactaaggaggtgaacgactaatgattctcgtactactcgttgttagcgcaatcgcgctcttcttatcatttatctacgttcaccaaaacacgttacgaatcagcctatccgttatctttgcggcactcttagtgacctcgatcgtcttcgtctccaagaatgatggtcaacattacgggatatggtcaaaacaacgacgaccaccacgcaatcattaaagtccgctggtagtagcaagcaacttgatttattgctctatcaaagtgtgggtaccgctgacaagcaccgggtctatatttataaaaagaccactaatcagaaaaaaagttagccatacgacagccagcgtcaagactgctaaccaagttaagacgacgaccgcgacacctaagttagttactaagacgacacggtggacttataagagtaacgccatgaagttctggtttggcttagccaacaatgacaaacagttgatcaagcgaaccaactacttctatatcaataagaactgggtcgtacttagcacaacccaagctaaacaattcagtaaattgatgaagcaacagcaagcgacattaaaagcgcgtgctaaagtctacgtgactaatcaggtcaaggccgcaatggtcaagaacccgacaatgagcaaagcgcaactcgcaaaagttcaaaaagcagccccccggctgctcaatatcaagccaatgccattcagagcatgcttaaaaccgttaaagctagcaaataacttgaactaacaataaaaatatctgacaagaccccggcatgccggggtctttgttgtctaaagatcatcatggcttgttccccctttcactaacgtcttgccaaaactagcgccggcgccccagcgtcaagactacacttattcaaaatcgatgcgccggttaattatgccggtggtttacaaaaaaatcacgtttcttttctgaaaatgtacactatctttactaagacatgattttgatgctttcgagcaaatgatacgattatcacgtaccaagttgattgttacgatgtcataggttagaaaggatgtttgttaatgctaaaaagttctgtgctctatagtactatagtaactgcaacgttgttggttccagcggtatttggtccagtcattaaagctagtgccaacaataccaagcctaccaattctctgtatccaaggccgtggcaattgccgcacctaagcagcacgtaattcgcaacacttcactagattctcatagtttatctgaactacagattaataaaattgatccttacattttagtcgtaaataatcaataccaacttaacaaaagggctacgaccattctaagtaataccgaattacaagcagtagaaaactcaatttcgattgctaatactactgtcaagcaacaacatttaaccatcgatcaaaaaacaaagactagtcagccaatgtcaaatacaaaggctgcctggcatagctactatacttctgcaaatttctggtggggcacacgttactatttcactagcaacgcagccgtagcacaaatgcaaaatgaattggcaaattatagtattgcattagggattaccggcgctcttggtggtgcactctcagttggcggagctgctatcgtttcggcgggcgctgacgcctacttaacaaaaatgtcaagcggatttaggctactacaatgctacacatctgcacaaccaaatttatatggatgttaatttcgctggcttttactcaatgcacgtgttagcttaaagaaccgcagtctaaaggaatgattacatgcacgataactcaacatcaggattgttttggatcatcatcgcccttttactttatatgattagtaaaacagaccctaaaaattttataattaagcaaataagacgatttggttggctgatcaacttggttattctggcttacattatcgtcgggcaaatccagcaacccactggcgtattacaaatcatggtcttaatagtcatcggattttcaacaattagcttgatttacgctcgctttaaacatcaaccttaattagcactaagacaaagacttgcccgtgagcaactgatactcagacatgttcggcaacaaactccacgtaagaaaacaaacgtccgcgttgactaaatcaacgtggacgtttgtttttataatcgcacataactgcattattaaaactgtcagacgatctttggtgattttaccgctgaacgactaacaactaaccgacgcaaacagccggtcggccactgacggttgaacaggtgccgggttgagtaggctctcggcgtcatcgtagtcatcatcatcgtcatattgatcatcagtatcataatcgtcgtcatcagactcactatcagtatcatcatcgtaatcgtcatcggattgggtttcgctgtcatcggcgtcatcacgattcgaatcttcatcgtcatcatcttctgagtaatccgaatcgctgtcagcatcgctattagtatcggaatcatcgtcggtatcgtcattcgaatccgtatcttgatcactccaatcgtcatcagccgaatccgcgtcggtgtcgttcgtgtcatcattcgaatcagtcgtttgctcatcccgatccgaataatcgtcattatcgtcggcctgatcggcatattcgtcatctaattcttcttcagcagcatcatccacatcactatcgtcggcaaaaagtgccaaaatgaaccaatcgggcacatcgtctaatgcggccatgttccacttgtttttagcggcagcaatcttccgacgtaacgccgctgctcgtttcgcttcagccgcactaactttcatattcgtcttggcctttttgccgcagtcaataactgttttaccttagccttcaacggtttcaaatatggctttttatcccagttgatggctgcgcaacgtttgagcacgtccgctgaatagttgccgttcttcacctttaactgtgctttaacatcatctgacaattgctgatattcctgataatcactggttacggtgactttcaactgtttcagcttattcatcaaacttgttgcccgttcgtaatcttgacacccttatcaaccgtcgtcagcgccgttttaacttttccggccttcaactccgatgtggtcgtcaagtagggcctgcgtttgatcccccgggtacgcctgtgccttttcatccttgggcttctgcgctagcgcgttatcaaaatacgtcagcgctttttggtatttattctcagcaaccgcatttaaccccttctcgattgactgcgaatacgccttgttatggcagccagctaaaccgaccaccatcaaacataacagtatcaataatgatacccggtgcttccccgatttcatccccgcttcactatcctttttggttggtatttatgcttcaataagtataccgttagtccctcaatcctcgctagcccatataaattaatttatattccgattgaacatttaaaaaatagtgtccgctccaaaacaccaatcaggactaattatgattaaaccgtgccgattaggtggattcctgttcgtcagccggtgcgcgtcctatgtcgacctccggggctgggtgacaattgctggaacgtaagccgacgtcgatttgagctaacgcataacccgcgtcatctcaaatacaagagtcttattctaagccggaagcaacccacttccgactaagaataatttggctactgagcattgtcacccagcccctccggtcgggaaaccgctcgaatggctgatgaacgaccacctaatttggtacaattagtcgctgactattttgatgctggaagtttaaacaaagcgctaggtgcattaagcactctatcaagagattaaatcctactacaccgattcaggattagttagccatctcaatattatttttagtctgacagttgattgacaaaattaccgtttatgaaaagcaacgaccaattcatcaaaagttgggtacctcaccgtctgccattcgaatactatcccgactggaaggcatttttgacaatgcccagtggtgaaagttcacttagcaagcgttctgtgcttggttagtgaaaggccagtatttgagacgtggtttttcggctcaaatctgtgcccaccacgttccggcaattggcagaaatgccttggaggtcgatgtaggacgaaccaatctaagcatatttacgctaacttgaacttttcccagcgggtctaagctggctgcttttgaacttaagaatcggcacgttttaatcatgattgtttgataacgatgagtaataaaaaaacaatcgcaccaattctagtagaatcggtgcgattgtcttaacttacttatttattgagctgcacactgttcacaaagtggcattaaatctttcaaatcctcgacggatgagccattttctaagaagcaattgaccatatctagccaatattcatcatcggcgctaaaatgcgcgttgacatccttgcaaggtaataacccggcattggtataggcgacgattttatcagcagcgaccccgctatgggctgctaattgttccagagtcattttctctcaccatttgtcctttcaaaaaatcaatgtgatcatgttacgcccccagcttttgaaatgcaagcaacaatttcgtaacgtcacgattaaaagtcaatgataattttcttcattatttccaccgaaagtagtaaactaactcttaacccgcctttgcctcattcgtcaccctactattggcggatatcaagcgtgtttttcatcacagcacgcactcaaacttaacctacatagttatcctgtttcatgaaccacactaattgtcagataatcctatttagtgctggttaacgcatacttattgaatcggaggtcgtacatttatggattctagtttaacctttcgcgcgggcatcaaagatgtcattcccaccgtctttggatacattggcgttggcctagcaatgggcattgttgccaacacgagtcacctatcagtttgggccgttctactcatgtcactaatcgtctatgctggttccgcacaatttattatcgtcagtatgctcctagcgggtagtccgatttcggcaatcgtcttatccacttttttgattaattcacgcatgattttaatgagcagcatgtcagtcgctcaatatttcaaaaaagagtcgttattgcaaaatatcggactgggatcgttactaactgatgagaccttcgcgctcagcatgaacaagctcaatcagaccaatcaacaattaaaaacgagttggttacacgctgctaacattgtggcttacttggtttgggcagccgcgacagtggtggggtgccttttaggtaacttgattactgaccctaaccagttcggcttggatttcgccgttgttggtatgttcattggtttactttacttgcagatcatcacggatcgcagtaaatcattgccgacccagttgtgggtcgtactatttgtggccctcgccatgtattttctcatgcgttgggttccgggcaacttggctttgatctttgcgacgctactcggttgcggttttggaatggtggtggaccataaatgagtacttacatttttgtgaccatcttactctgcggcctcgtgacttggctatcacgcattgtcccgtttgccatcattaaaaatctgtcagtcccccaatggctaatcagctttttatcatttgtgccaattgccattatgaccgctatttttgttgaaagtctgctcacctaccatgcgggacactggccagaatttaatctcccaaatatttatgcctcaattcccgccattcttgcaggagtgctcaccaaaagtttactagccgtcgttataacaggcatcgttgccatggccgtattgcgcctagttggctgggcttagagcgcaagggcacatctaatttaatattcccacttaaacgtcccgcaaatttgtgcatgagtttgcgggatttttctgtgactttttcagccataaggccagcaatcagcacctaaatgtgtcatgtcaataacggtcaattcgaactaaccaaatagtcagtagaaatccgctccgccaaggaaccggcatccaactaattggacgtttcgcgcaatatgaaatttttatctcaaatgaaagcgttccatctgcgcgctccgctttatcttatgaattaaagcaagtataatagtcaaagtgtacgtcgcggattgtcaagcataattatgacagacattggtaagaaaccgttataattgttcagagtgctttacatccgtgaatgaaacgggtaaattaacaacgaaccatctgtacacatatagtagataagaactgtctaaactttaaagattgagagatgaacagacatgtgcggttttgctggttgcttaactgatcggactaaagcggataacgcagcttacgatcagaccatccacgaaatgactaaaatgattgtccatcggggacccgatgatgacggttattttgctgatgacaacattaccatgggttttcggcgcttaagtatcattgacttagccggtggtcaccaaccactatcttatgataatgaacgttactggatgacatttaacggggaaatttataactacgttgaattacgcttgaacaactcaaacaagaaggctacgaattcaaaacaagctccgattctgaagtaattcttgcgatgtacgccaagtaccacgctgacgcaacgaagtacttacggggaatgtttgctttcgtcatctgggataaacaagaaaaacgttatttgccgcgcgcgatcagttcgggatcaagccgttctattacgctatcagtggtgatgacttctattatgcttctgaaagcaaggccatttacaagattttaaaggataaaaccttcgataaaaatgccttacaagattacatgacgttccaatttgttcctgaaccagaaacactcacaaaagaaatcaaaatgctcgcccctggttgctccttgacgaaaaagttggggtctgcgccacggatcgatcggtattatcaccgtgaattccatccggtccaacgttctgaagacgagtatgccaaaaaaatcaaagatgccttaattgactccgttaagattcacatgccgttccgatgtaccagttggttctttcctttcaggcgggatcgactcatcaatcatcgtcgcgattgcaaaaacttcaacccaaaccttgaaacgatctccgttggtttcgaacgtgaagggtatagtgaacttgacgttgctcaagagaccgctgaaaagcttggtgttaagaattacagcatgacgattacgcctgaagccttcatgaaggccttcccgcactttgtgtggagcatggatgatccgttggctgacccggccgctgtgccgcagtatttcttagccaaagaagcggtcaaacacgttaaggtttgtttgactggtgaaggcgctgacgaactcttcggtggctacaccatctatcatgaaccagaatcattgaaaccgttccgctacacgaaaccgattaatggtgccttgaagcgtatcgcactcatgatgccagagggaatgcgtggtcggtcattcttactacgagggaccaccccattagaaaattcgcgctatgttgggaacgcctttatctttggtgaacaagaaaaacaagccttcttcaagaattacaatcagaaccatccgttccagtccatcacgcaaccgctctatgatgaatccgtcgactatgatccaatcagtcggatgcaattcatcgatatgcacacgtggttaaacggtgacttgttgcataacgccgaccggacaacgatggcgcacagtttggaactgcggaccccgtttgttgaccgtgaagtgtataacttagcagccgaaattccagctgatcttcgaattagtcacggcacaacaaagtacattcttcgtaaagcggtcgaagacatcgtgccagcgcacgtccttcaccgtaaaagcttggtttcccagtaccaatttggttctggctcaaagatgaaatgtacgactgggctaagcagatcattaacgattcgcaaactgaccaatacttcaataaggactacttcttgaaactcttagatgaccactaaggccggcgttcgggataattctcggaaactctggacggtcctcaccttcatgatgtggcaccgactctatgtcgaatctgaccacttgatggatagccccgaagctaacgccgttgcggaaaaagtcgaggagttttagatcaatggaaattattgttcaaaagttcggcggcacgtcagtcaaggacgaagccgcccgtattcaagctttaaagcacgttcaatacgccgtcgatcagggcgataaagtcattgtcgttgtctcagcaattggccggaaaggtgccccttacgccaccgactcattactcggattagttggggccgagcactcccgcttaaccaatcgagaactcgacatgttggtctcagttggggaaaccatctcgaccgctgtctttaccgagttagcgcgtaagcaaggcctaaacgtcacggccatgactggtcatgatgctggcatcgtgactaacgacgattttcaaaatgcgaagattctccgcgttgatccgaaaccaatcacggacgcctttattgacgccgacgtggtagtcgtaactggttttcaaggtgctactgagagcggccacattactacgattggccgtggtggttccgatacatcagcagccatcctcggcgccgctttaaaagcaaaacgtgttgatatttttactgatgtcaacggcatgatgactgccgatccacgactcgtcacccacgcccgcttcattaaggccatcagctacgaagaacttgctaacatggcccatgaaggtgctaaggtcattcatccgcgtgctgttgaaattgcagaacaagctcacgtgccgatgcggattcggtcaacttatcaggaacccgacgaattagggactttagtcactgaccggaccacgacccaaatcgaacattatcgtaccgtgacagggattgcacaccaaactgatttgacgcaatttactgttcctaccgatacgttaagttcaagtgcctatattttccaattgatggcacagcacggtttgagtgttgactttattaacattacaccacaccaagttgtcttcaacctggttgatggtgacgcggacgttgccaagcagctactgactgacgcgcacgtccattgtcagtcaattgcgaactgtgctaaagtttccgttgtcggtgctggtatcactgggacacccggcgtcactgctcggatcgtctcggcattagctgcacaacatatcgatattttacaatcgaccgatagttatacgaccatctgggtgctcgttaaggaagccgatttaaaagcggccatgaacgccttacatgatgagttcttaggaatcgaataaccatccccgcaagtccggcttaattgccgggctttttgttgacctagattggcctggagatggcacgttcaaccagcagcacaccatgtaccgagcgattacaagcataatttcaattctcatttggggtgacaattatccggtttgcatgtattctagaaacagtaactttattgaaaaggacgctaatattatgcaagcaagtcaattaattaatagtttaaaattcaagcgggttcagcccgccttgaccacggactttgatgtcaccatgctgacgcaggatacccgcgaagttcagcccggcgccatgtttattgccgtcgttggttatcacgtcgacggtcacgacctcgttgatcaggccatcggaaaaggggccaagatcatcgtggcgtcaaaacctttagacgtcaacgtaccggtcatctacgttgaaaacaccgaacgcgctatggcaattcttgccgacgttttctacggtgcgcctagtcaaaagatgcggatgattggggtgacgggtaccaatggtaagaccactgtcacccacctgatcgaacaaatctatcgtgatcagcagcaagccaccggcctgattgggaccatgtatcgcaaaatcaaggatgaaaaactgccaactgccaacaccaacccccgacgccatcacaacgcaacggactctagcggccatgcgggatgccggtgttgaaactgtcgccatggaagtttcttcaattgccctcgtactcggacgggtctggggattgattacgacatcgccgttttcacgaacttgacgcaagaccatttggatttccacaaaacaatggctaagtacacggaagccaaggccatgctctttgcacaactgggcaataagtacagcgccgacggaactaataaggtcgctgttctgaacaccgatgatcccgttggccgtgaatttgaacagtacacggcagcgcacgtactaacatttggactcaaaccagatgccatgatcaacgcacaaaatgttgaaatcaagagccacgggactgaatttgacctctccgtcttcggccacgtaacccacgtgacgatgcaactgattggccagttcaacgtgtacaacatgctggcggccttcgccgcagcttacgctagcaacatccccgaagaccaaatcattaagtcactggagaaggttaccggcgttaagggccgcttccaatccgttccttcccacacgggtgtcagtgtcatcgttgactactcacacactccggacggcttattgaatgccctagaaacgattcaagatttcgcgactaaggatatttattgcgtcgtcggctgtggtggtgatcgcgacaagacgaaacggccaaagatggctaaaattgctgtcgaacacagtactaagccaatctttacttctgacaatcctcggacggaagacccaaccatgattctaaatgacatggttgccggcgtgccaaacgccgacgtgcccgtctacgaagaccgccacgttgccatcgccaaggccattgaagcagcacaacccggcgacgttgttttaatcgctggtaaaggccacgaagattatcaaatcatcggccggactaagcatcactttgatgacagtgaagaagccgctaaagcactagctagctctgaaaccaaccattgattaatggtcaaaacagaactgaccgacaaggctattttcaattctatttctgttaacaattggtgacatccgtgacacgcgtctttaaccattaacacccccagcaacagctaatttgattggccgttgctggggtgttttttgcttgtttggctttctcccaaccagcgctacaaaacaggcatcagtcgtgtttgtacaaaagatgcacccacctttcgattattaaccagccaaactatcgcctatctttgataattcacctaattcggaaatataattatgttgataaaaggggttaattatcattgttagtttaagtttaattcgtttgggggatttataatgtcaatttttcaaacttggaaacgccgaattgcatacggttccactgacatggccggtaatattatttggcaaatggtcagcacttacttactgttctattacacaacggtcgcgggcatctcagctggcttttgcgggaatgctgttcttcgtcgtgcgcttcattgatgcgtttgatgcattgatttatggttatttgattgatcatacacacacgaagtatggacaatcgcgcccctactttgtgtggtttggcattccgttagggttgctggccatgtcgctattcatgattccatcatttggcggcaataccacaatgcgactcgtctacatttcaatcacttacactttctttagcctgatttattctggtgccaacacgcccattacttcgattttaccaagcttgactgatgatagcgttgagcggaccaagttagcgagtgctcggatggtcatgacaaccatcgggaccagtgcagtggcggccatcactttgccaatggttaaattactcggcaaaggcaatcagtcgaaaggtttcaccctctgggctattatcttaggcctcgttatcatgggactcttcatctttgcttttctcaatctcaaggaaactaacggtgcacaaaatccagacggtaccactgagtcagccgaatcactctcaatctggcaaagcttgaagggtgcggctagcaacaaaccatggctattattagcctgctcattcattctgctacaaaccttctggatgctacggggaaattcagcgatcttctttatcaaatacgtctacggtcggcctgaattagcgccaattttcctggggattggctttgtttccgtcatcgggaacctgtccataccattcctatcacaacgctttaagaaccgtaacgttttgcagttttcactcgtactgggcgttatcggccaactactgctgccaatcgctgaaaagatgcgtagtgtgagcctactaattgctggctccgtcattttcttgattgcgatggggatcacgttcacgattgtcttcgcgatgctatcagataccgttgactactcaacgaaagtactgggcctaaatgaaaccggattcctatctgccgtaccaatgattggcgccaaattaggaatgggaattggcggttttctagccggtcaatttctcgcatggggacaattcaatgccaaggcagctgtacagtccggacgaaccattacatttattaatctcgcttttatttggatgccgattattttattagccgcgatgatttccatgatgcaattctatcggttagacgaaaaagaattacaagccaacaaggccgacgcagcggctaaagttgaacctaaggaggatgttgaatatgatgccaacaattaattcgattcaaacaaccgtcaacggcgtcgtcaaaatcgttaaaccatttaacaacgacatcgccggtgaacaatttgacccgcacgtccttcaaacactaacggccttcaaacaaccagccatccttgaaaatgatctagcggcgctccgcagtggtagtttaacccccgccatcgcggaccctgttggtgatgctgttacagttcaaagtcgaaatattacggctctgaatcgcacggtcagcgttgaatggctgacaccacaaaatgtcattaatcacacagtactggtctacttccacggtggtgccttttacggcggtgttcccggcaataatacggtccttttaaagctggtcgcagctaaaagtcactgcgagattcttaatgtcgattacagcttagcgccagaagcaccagcacccgctggtattttagacgggctcgcgattttccaatatttggaacaacgtgacgctgaaacaatgattaccgttgctggcgattcggctggcgctaacgtcatcatggctgcaacaaatctgaatcaacaactcggtagcaatcgtatcaatcaacaactgctgttgtacccagttaccgccccaaatgctgaccacgccggtccactctgggatttggccgcctttccgattattgactcacagcgtgccattctcaccaactatcacgacctctttcggcaacttgacagcatcatgacgggattattatgttccagagaactttgattcacattctccactcatctcaccgctacaccaggaaaacttcacaatgacaccaccaaccacgatcatggtcggcgagtttgatcccttccgaccacaagcttgggcttatgcacaacgcctggccgctgccgatactgcgaccacgtttattcagtatcagggcttgaaccacgctttcgcaccattagtggatcagtattggcaaagccaagatgtggcccaagtgatggcggccgcgttaatttagcgactagggcatatcaaaaatcaccagtatcacgttgcagaaatcacatgtaaaaaacaagcggactgataaaaaccgccccgcattttactatccgaaatgcgggcggtttcgcgttaagctaacatttaagtctgagacttgtgctatactcttggcatgggggattaacgtgaacaaaaatgataaagccaagcgtttgatgcaacaaatcgacgttcggcctataatgatcctgaagttaaacaagacgcacaagttcgtgctgacttacttcgctatgctatggaacttgacaagaacggtaactatttattaattgccactaaagttaacggcatggcaatgcgcgtcatgcgtgatcacatgcaccaaccactccaagcaattaacacactctacacccaaaccgcccgcacctccgaatattattggggcgtggcggcagctagtatttttagtgggctgtggtaaagcactatcacgtgcgagcgctcactataaatcatattaacaacagttttgaaccggaacacagacaaataacttgaatcaaccgttaatttcaaagggacgctcctgacaaaccatgccagaagcgtccctttactaactacttaaaattttatcgatcagagtcaagttaacagctaaagtaaggcgttgtacttggctcagccatttacttcaagtacccggtttcattccaagtcgtcagttcaaaatgctgattatccgtcgtcgataacactgtcaggctatcattatccacgataccgtggcccactgtcttcataacttgcccatcgaccacaaaaggtgctcgtaattctgctacggggacacccattaacgccttgacagtcatcgtcgtcaccagaccgtgcgatacgattaatagtggttgcgtgctagctaccccaacttgatcaatcaaacgatgtagcgtcgaagtcgttcgggtgacaaaatccgcataactttcgccaccgccagctagttccggtcggtattcggcgggtttagtaaaaataacttgggcgtaggactgcggctgtacttccgcttcctgtttgccgtcccaatcaccaaaatcaaactcacgcaagccatcgtcgatttgaatcggcggttgccactgattggcagccacaatgtatttcgccgtatccagcgctcgttgctgcggactgctatatactgctgaaaattgggtgggctgcttaagtaatcaccagcggcttttgccccatcgattccgctagcaaccagcggggaatctgctcgtccaccttgaaatcggtgttctaagttatattgtgttcgaccgtgacgaatgaaataaatctgcatggcacgttcaccttcctaatccgttcaatagtttaattctaactgtgtcatgctcaatagaaaagtcttcagtgccataatgacgtaaaaaaataccgtggtctaagaaacacaccacgatatttcagttattatgataaaggcttaaccaagtgctggtacggatgtgtgccaatcatgagctgaccatccgggacaaaaccatgccggtggtataacttagctgcccggggattgccatcatcaacgtttaaactcagtttcgtggcccccagttgaccaacgagtcctggtaatgcttctagtaaggcactaccaactccgtgaccctgagcttgcggatcaactgccaacatgcttaaataccgactcattcggccgggtctcaccacctaattccagtggtgcctcaaaccccgcatgatgacctgaagtcgtccgcaacaaatcgtttacagcgacttcattcttcgctaagtgcccaaacgcgacaccgacgattttgtgatccatgaccgccacaaaagtctgcgctaacccatctaaattggccggtcgctgatacaactcagtcaacattgccaataggtcggcctcgctaacatttttaagactggcatttccatatcacggtaaatcatcgcaatcaatggtgcaatttgagcactatcttgcggttgtgccgttcgaatttccatcatcacaacgctcccaactgttttctcaaccgtagcaaatcccgcggtcatcgtcaatcgttgtgcttaatttgttgccgatgttgaatcgtcatcacccacgtcgtgacgggaactaccaggataacgccaattaacgagaataataccattaatacttccgcaacaaaatattttattattgataacactcccgaaggaataatgtaagcccgcaaaccagataaatagcgccaagaagccaccaaaaagccgaaaaacaaggtattaaaagtcgtcccgataatctgcttaccaatactgataccatcgatatagagtcgcttagttggcaactgcggatgctgcgccagaatttcactcagaccagccgcaatcgcaatagcagcttccgcaatggcccctagtgtacttaaaattgcttcagttactgctacgccaataaaggagaccccaatggctaacgacataccttccagatcttcactatcttctaaactaaagccccgcgccatgatccaattttcaacgggaaaaataatcagcactaaaatgaccataacaatcaatgctgcaatataagctggcttggccgccacttcgttgtcctccccaaagaaaatcgtgaaggccaagatgattgtcccaatgaccaacgacacccccattggctggaaagccccatgaaatcaaaacaacggctaaaaacaacaatccaaagttaaataacaaactcaaaaaggccgtcgctccagtcttaccaccaattaatgtcatcaagcctagtaagatcaatcctaaaacggtaatcgtgttcataccatcaccgccttaggcatcaatcgactggctaaccaactggctactggaatcgctaaaacgataccgataccagaaatcaaactttggaccatccccaacgacatattcattgtaaaagtgtaaccccagctattgccgttacggaaatagagcaaagtcatcgcgaaagtatccgccatgaaaatcaaaaatagcacgttgatcaagggccccataatagaccggccaatttgaatacccgacttaaatacttgtcgtggtgcaatgtccgggcgctccgttttcaattgaaacaatgaagcaacaatatctgttgattcatccatgactgctccgagtgaaccgaggactgtttcgactaaaaataacggtcgaggaaacgcgtcacgtactgcatcgattcataagtcacaccacgctcatgggtcaccgcaaagacaatcaaactaataatgacagccagtccgtgccaaccacagtcgcgcccaatgttactaacatttgacgactaaaaccgagcactagcaacagtgtgagcacggcgaagattacggccaatacgccaaagagcgggtaaatgtggccaccattagtagctaagtcgatctgaatggcggcataaaatagtacagcattgagtgcaacactcaaaaaggccatcagaccgctgaaacgcatgattagcaagagcagtgctagggctaaccacgcgacaaacgccaatgcggtatctcgttttaacccctgaatcgtcactgcactactatgatcactaggaatccgtaagaaaacttgattacggacgtgatacggctgatccattgcgcccgagcgcgtatacgtatttcttgatctggtaagttcgaccacgatgtgccttattgagcacccggaccgttaccaactgtgtcaccgtcgcatccttattttcaaattcatccgtcgtcgtacttcgactcttagtctgcacgtgggtcacttgtgcaactgtctgctgataaagtcccgcattaacccgggtcaatccaaccccgattagtcctaaaacaatcaccagcagtgttaaccacaacccccaccgttgcttgattcgctgtttcacattttcacctttttcacttcaatggtcaccagtttaccacccattccccaatacaaacttcgattctggcaatctttaacagaatctaagtttctacggtaatctaggccgttacttgaacgcgtaaagctttcagccaagcaatttcttcctcatcgtggaggcgctgagcaatttttagtcccttttcaatcaatgctagggcctgttcaggctgctgatggacccgccattcataaacggcagttaacttataatgagccaaaggttggtagcgacgtaataactgttgaacaccatcatcttgataccaggctatgatctggggtcacgatgattggtgaccaagttccagtacaatgttgcatctaaatacttcgccaaatcagctggcggcaacgtattgaaacttggctccaagcgactcaaccccgctaacagttcgggggtgtccagcccatgttgaagtccccattccagaatcaaccaggcttgccggacgactaaataattccgattgccaccatcgcgcggcataacaatcatacttgtatcaaggtcacggacactaccagtctgaaccttaacggccgcagcacacgcagtgacatacgcggcggtcatcgccgccgttgattcgcgtgcccgccgaaattcctgtcccgccgtgggataaccgtgcaagttcattggtaataattgggcggctttcaacgtattgacccagatccaaataatgaacgcgcaaaacaaccataaatcgaaactaaacttaaattgattcagagttattaaactgagcatgaccgtcagtaagttgaacaggccaccgccaaaacaataaatggcgtgattgaaccgtttggcatccgccgggggtgctgccacgatatgtggatgacgcgtcagcggtcgttctaatttccaatgaccacgaacccgacttaattgaagtcgaaaaccggtaatccggacaattcgagcaccaattaatcgaaatccgacccactgaccgagccaatggattaacgtcgcacctagttcgctggcgactagtgccaatcctagccaaccgactgttgcaataaattgtccaaaaacttgcatgctattcctcctcgtaccttgattgacagcctttatttaacaaaattaattttgaaatcaataacacgtttttgggcatgacccatgattagtttttgacaaagttagattcaaaaaccggcagcttggatgcgccaaaacccgaaaccaatcacagcatgctgccaaataaaaattcatctaatttaacatgttttaattatggttcatacgcctggcaaccagtaccaagtgtcctcattttctaattcgacgataccatattaattatacgcgtggacactgaaataatcgctggtacttcgtaattgctcttattatagcaaaacaagctgacctccggcgattaagacgccaagcccagcttgctaatcaattgaattttaatgtcgttgttgctgaatgcacatgccgtattccttaacgacgccggtgtttaacaacagtgaagaaatgtaaaatcattgctaaaagaacgtaaaagacgacgacaaagacgccgtagtaggcccaaaaattgttcagcggaatcaattgttgaatccccgcttcgattcccattgtcagtagtgccattaccgcaatcatgaagaataattgaatataccgtttcaccgtactgtcatccctttcctttttatgtgcagcccgcgcgccgacccgttcacattctgcttgcttagcagctgtgatggtttgcataccccacgttttagttacgacaatctcccgtaatttgatgagaccacccatcgtcaaaaatttatcaagtgttttaaacgttgcgtcagtcacgccggtcaaataattttcaataccacccgcgtaacaatccgtgatcgtcacataatgcttgttcttaaagcgatcaggtactgcttcacccacggaattaaaccgtgcgatccgcccccgaaaacagtcacagaagtttttcattacccccgataagctccccaaataggttggtgcagctaatacccagacatccgccgccattaattttgcttccagcgcgtctaagtcagcattcggttgactatcgtgatctggtcgcaactcataatcgttgaggttgactagttccgtgtcagcgctggccgcggccccctttaagacggcttgcagtagctgggcagtcacgccatcagcgcgatgcgcacctaatattcctaagactttcacattttccactcccatcattcattcaaaagctatttttattttaacgcatttcaacataaaaatatggttatcaaacgaacagcaattgttaaacccgctaatagtacttacttttaacaaaaaggtttgacaatcgattaacgacttgctttaattatacataagtacgaacgttccaataacaattagtctaactgacaacttgtagacttaaagttttcttggctgcaactatttcaccagaacttgaacaatcgagctgtcataccaacacttaacaactaattcagcgtactgccgatggggagttagtccttaagtgtaaattgaatttgaaaggacgcagtcaccatggctaattttcaacaatccgaaacggcacttattgaaagtgccacactaattaatatcttcgccgaaaaattcggcgtcagattatcattgctctggggaacagctgataatggtctcaacgttactgatattaccgccttggtcaatatttcacgccccgccgtttcacatcatctacgcttaatgcgtgaagctggggtcattgatatgcgtagtaacggggtcgagcatatttattttctcacgttaaccgcaccattacagcaattacaggcaacttttgcgacgctaacggctgataacgcgccacttagtcagtcgtaagcactagcgcctcattcaatagtcaccgcaaccttcaggataacgcgagcacgcaacttacccgctaaacgttagcttgattttagacggttgccaaccaaaaatcggcactgccagaatgttcaacgcattctagcagtgccgatttttattaaccattcatccggatgatcactggtcctaaactgaacttagtcgtgattcaaggcttgcagatcagctggcaatgccgcctcaaagtgtaaagtctgttccgaaaaggggtcaaagaactcgtaaactagcggcgtgtaaggcttgccgttgaatccacgccaagttaccgccatacagcgcatcacctaataaggggtgcccaagcgtcgttagatggacccgaatttgatgcgtccgtccagtcacaagttccaaccgtaaccgactcacgttatgctgcaattggtccgcctccacttgatacgtcgtaatggcgcgttggcccgccgtagtgaccactcgccgaggactgtcagccacccggccaatcgggcgatcaattgtgccactagccggcgtaatggtcccttcgatccaagcttgatacgtcttcactaattgcgccgcaattcggggctctgtcagcatcccccgcgccacccgatgtttagcaactaacacaaggccactcgtatcccggtccaaccgcgtgatcaggtgcggtcgttgattactggcatgactggctatcaaataacccttgattcgattgaccaacgtatcggtccgattactaggccccggcacgctggttaacccggctggtttattaagaacgagccaattagcatcttcatactcaatttggattggttgttcgctgacggctaccgctgtatccggtgcctcgtctggtagttgaattcccgcaatatcgccatcatgaatggtaataacgcccgtttgaacttgattattgacaagaaacgcgccggtgccatgcttgattgccttgattgttcgcatactgatggcatgcgtcgtcaagaatcgtttcattgccattgattgcccctggtgttgccaagtaaattccatacgtgttactccatttcatctcgtagtttaccaatcagcgatctaatcagtttcctcatcggtgctagttgctgattccgcatgagctgccgctcgaatcgtcgccataaaggtttcaccatacttttcaagtttgctggccccgacccctttgaccattaagaaagctgcgtcgtcttctggcatcaggtcacacatcgaaatgaagcgtccggtcagaaaaaatcacaaatggtggtacgccctgttcttccgccaattgacgccgaagtgtccgcaactgttcgaagagggcactgttctctggtaccgtctgttgcaccttttgggccgtctttcggtgtaccgtggtcgttcctttaagcacggccactccactcgctgagactgtcagtgttggatactgaccacccaccgactgcaaataaccgctcgcagtcaaaaatcgatcagttccacgacactcttctgtcgctgcccggacatcaacccgtacgtcgacaacgtattgaggttcgattcgcggacccgttgattattagcgcccgtcaatacctgggccacgaccctttaccgaaccgggaatgaagcctaacgacgcacgataagacttgttgagctgccgtggtgatatcctgtgattcccgctgatcagtacaattactacaccgaccacacggcgcggatttttcaccaaagtatttcaagataaactgttgtaaacagccctgggtattcgcataccgtgtcatcacctgtagcttctgatacgccaggtgtcggtgctccgtatccatctccgactcatcaataaagaagtgctgaagttgaatatcaaccggtcgaaaaatcaaaatcgcttcactaggtaacccatcccggccagcccgaccggcttcctgataataagcttccaaagttccggggaccgcgcgtgaatcacaaaacgcacgttactcttatcaatgcccattccaaacgcgttggttgccaccatgacgtcaacacggtcgtacaagaaatcctcttggttttgccgccgaaccgcatcatctagcccagcgtggtacggcgtggccttaatatcatgcttttgcaacaaactcgtcagacgcatcacttctttacgggtgctggcgtaaataatcccggcttcaccatgattaactttcaaataatctaaaatgtaacggtccgtgtcttggtccttgaccaccgtcaaatccaagttatcgcgggcaaaaccagtattcacttcatgttgtggatcgatcgctaagcggccgcaaatatccgcagcaacttgctcagttgccgtcgccgttaaagctagaacttgcggatgggtcggcaattgttcaatcgccgtgctgagcgctaaataactgggacgaaaatcgtgcccccactgtgaaatacagtgggcctcatcaattgctaacagttgaatgggcaaccggcccagcgcttgaataaagtaatccgaatctaaccgctcgggtgccacgtaaagtaaggtataatcccccgcccgtagttcttggagccgttcgttaatctcttggaaatccagtgaactgttaataaaagtcgccgcgatgccattatcatttaacgcgtctacctgatctttcattaaagaaatcaatggtgagacaacgacggtcagcccctgaaaaagtaacgctgggatttggtaaaacataatgacttaccacccccagtcggcataatcgctagggtgttttcaccggccaacacttgttcaatcactgctttttgccccggtcggaattcatcatatccgaacgtggtctttaatacttgctgtgccgccgctaagtcaatcatcacacgtaaactccctctttgaattaatactctcattctaccgagaataccggcccatgacaagaacgcgccccggtaatcactaggtacgttaagtcgcacttgcgccacgaaaactatcaaaataccgaaaagtgcccgtccctattgattttataggaacggacactttaaagagaccgatatcgattaaacgaccatatcagattggccatcaaagggcactcgcccacacagtttatatgtacaatgctgacttagccttgcttgggtcggccacggtgatccaccaaaccttccatgccgtgttgtcgatattttcgtacccatgtatagacttgtggatacgaaacacattaaaatgcttagcggcttctcgataatcgttgcaatggtccagcgtatactttacgatcgcaattcgttcttccagcgttgcgcgtcgtcctcgatccatgactcggcctcctctcattcactactattcatcataccaagagttctcaattttttgtagctttttccccgtgacttgcctgattcgttgcgatttttaataaattatttcgaatcagtccagtgcacctagcgctcatcttaaaataaatttgttaacgcagttattttgcttgcatttaagaacgtatgttcgtatactcgtattgaggtgattagcatgcagtcaaaaaatctaaccgttaagtatttaaataaaagcaagatattaaagttggacccctttatgttgtacttacaagtcacgccattaaaggcgaccgagcctatgcccatcaactgcatcatcgtcaagcatgcattgactttattttaccaactccaacctgacgcactaactagcactctacggtcactataacaccaggcaccaattcgtgattaccaaattcatggttcgatctgcagtgcaaacactagccagctaatgtacaaagccgctaaaatataagtacttagatcagaggagctgttgtcgatgatgccaacgaacctaaccttacttgagcgtaagatctcaaataacttgaattgtctatactttgtcaaccatcccgtttaccgtattcaaaaggaccatcaattagcactcgcttcagaatacagccttgccggcaacgtgaccgaaattatctgtgatgaacagcagcgctatcatattttattcgtggcgcgtaaagaaattgtcttaactgaaaagaaggtcgctaaagtaaccaataaccagctcgggcgggataccgttcaatttctggcgacgctgggataccagtttccccgcgcagccggccggtgaactaagccaacccacgatcctaccttcaccaacggaacggaatttggagtgaatgtccgaccgcttacgtaatcatcgactgcgagttcggcactcgctttcgtcgtaatggctccgctaaagccgtcagttggcacgtcatcgaatcacccgaattacgggctagtatcttccagctcagtgccatcggtttttcccatcatacgcagacagcgccttttttcaatcgttacttcgatgatcctaactttttacctgacaaaaagttggccggtttatcagcaactggcttaacgaccgtcgcttacgaggcgcaaggcgacccctgacgattctaaaagcatttatccagcaagttatccagccacaactcccctcgttttttgggatcagacacaggacatgaaacacattcgattattactaactcagtattatcagcaattgacccccaccgaacagcagctagtcagtcacccggtcacgatttttgatgcccaagcctatacgaataccttgatcaatcgtggcaaccataaggtcggtaggccatgatctgccattaaatggcttagccgcactctttaatatcagcaatccacaccagcataacgccatttgggatgttcagacaactgaattagtcatggttaagcttgctgaactaactcaccaaacgccggtaatcactacaccgcccgcaccgatcgcactaccagctacggtgccagcggtggttccgtcaatccagacgcctagccccacaccacaacatgccagccacgcgcaagttcaccagttacgggcacgtggcaagacttaccgtgaaattgcggcggtcaccggttttagtattagcgggattaattatattctcaaaaaagcccgttctatcccgacccgctcagaaagcgtataatgatattaatagcttaaaaggagtgttttaatatcatggaaaaacgtattaaaggttcatgtaccacgattctcgtcggtaaaaagcctcaatcgatggctcgaccattatttcacgaaacgatgatggtcacgaagccctagaccccgaacgattagttgtggtcaatcccgcagatcaaccccggcactatcagtccgtcattagtaaggtcgaagtcgacttacctgacaatcccttacggtatacttcaattcccaactcaatcttgaccaatgggacctggccagcagcaggggatcaacagtgagaacatcgccatgtccgcaaccgaaaccatcaccacgaactcgcgtatcttgggaatcgatcccttcgttgccggcggaattggtgaagaagacctttgcaccctagtattaccatacattcacagcgccaaggaaggcgttactcgtctaggtgccccgcttgaacaatacgggacttacgaaccaaacggtatcgctttttctgatcaagacgaaatctggtggttagaaaccattggtggtcaccactgggctgctaaacgtattcctgacgatgcttacgtggttgctccgaaccgcatgaatattgacgatttcgattttaacgctgatgataccttagcttcagctgaccttgaacaattaattgaagattaccacttgaatcctgactttgaccgtgtcaacttgcggcacatctttggaagtgcttcaatcaaagatacggtttacaacaaccccgggcttggttcggtcagaaatacttcacgccggacgttgtgcaagatccaatggaacaagacttaccattcatctgccatgctaaccgtaagatttctatcgaagacgtcaagttcgttttgagttctcactttgaaaacacgaaatacgatgtttacgggagtggctctgaagctgacaaaacccttttccggccaatcgggatcaaccgtaaccacgatgtgcacatcttacagattcgcaacaacgtccccgctgctgttgccggtattcactggttagcctttggtgccaataccttcaacacggtcgtaccattctatgcaaatgtcaatgacacgccagctagctactaaaagatgcggacggcacctttaatctcaaccacatgtactggttaagctgtacaaccgcccttttgggtgacaccgactacgacttttacgtggatatgcggaatagttacgaactcgaagccatgagtgcttaccgtaaaatcgagaatgataccgacgctgacttggctaaccaccaagacgtcacggcctatcttgaaacggctaaccaacaattggccgataccgcgatgaagttacaaactaaattactcggcgatatggtcattgccggttctgaaaaaatgaaattacgttataatttgaacgattaattaagcccggtagcttgcggttttagctaagatttttatggtgaattcatgagactaaactaatttatttttaatttagtggtttacaaataccagaatcgtgctaatataaatgtcacaagataaaaaacggaggaaagaggagtacgattagtcaacccgccagtgaatcgggagtgagtggagaaaaaaaacccgaccagaacttgactaatccgaaaaacactttcttagttgctaactgaaataacctcgttaaagtaggattagccgttaaccggtacgttaccatcggtggtgtatgtttgtacactattttaaagctggtttactgtaaggtaaacaacttgggtggtaccgcgaaagagtctttcgtcccttgataattcaagggatggaaggctcttttctttatcctgtaactaaaatctgaacttattttaaaggagaccacgcatatgcatttaattattccaaaggattacgatcctaaattatccgttaaagaaacccaacaggccattcgttacattcgtgaaacgttccaagatgaatttgggaagcaactaaacttatctcggctttcagcaccgatgttcgttgaaaagaaaactggtctgaacgataacttaaacggtgtcgaaaaacctgtctccttcactatgcaagacatgggtgatgaacaaatcgaaaaatcgttcactcacttgctaagtggaaacgggtcgctttaaagcgctacggttttgatatgcatgaaggtctctacacgaacatgaacgctattcgtaaggatgaagatttagacaattaccactccgcctacgttgatcaatgggattgggaaaaagtgatcagtaaggaagaacgaaccgttgaaactttgaaagccacggtacgtcaaatatttaaagtgatcaagcacatggaacacgaagtttggtacaagttcccacaagccgttcaccacttaccagacgaaattcacttcttaaccacacaagagctcgaagacatgtaccctgacatgacgccgcgcgaacgcgaaaacgccatttgcaagaaactcggctgtgtcttcttaatgcaaattggctggaagcttgattccggcgaacgtcacgatggccgcgcccccgactatgatgactggaaattgaacggcgatatcctcttctggtatgaaccattaagaccaagctatcgaaatctcaagtatgggaatccgggtcgatgctgaatcaatgaagaaacaacttaaagacgtggacgccgaagaccggcttagcttgccataccaccaaatgatcttgaacgcggacgtcccttacacgatcggtggcgggattggtcaatcacggctctgcatgttattacttggcaaagcccatgtcggtgaagtacaagctgccttgtggccacaagccatgatcgaccaatgtgccgaacataacattcatttactttaatctgatttaaaatccaacaagaaggagtgatcaatatcatggaaaccattagtattatcaacgccgctgaccatgtcaatgaacaagttaaaattggggtgtggatcagtaataagcgttctagcggcaaaattgcctttcttcaattacgcgatggcactgcaacttttcaaggggtagctctcaaaaacgagctcggtgaaacagcttttgcacaaactgaccgacctcgcgcaagaaactagcctctgggtcaccggcacgattcatgcagatacccgttccccctttggctacgagcttgccatctcacaatttgaagtggttgggactagtcacgactacccgatcacgcccaaggaccatggtattgatttcctgttggatcatcgccatctttggctacggtcatcgcgtcccaacgcaattatgcggattcgcaacgaggtcattcgagccgtttatgagttcttcaatgaccgcggttttattaagattgacgcgccgattttgaccggttccgctcctgaagggacgactgaattattcaaaactgattactttggtcaggacgcctatttatcacaatccggccagttatacggtgaagctggcgcaatggcgttcggcaaaatcttcacgtttggaccaacttttcgggccgaaaaatccaagactcgtcgccacttaacagaattctggcaacttgaacctgaaatggcctggatacatcaagatgaaagtctggaagtccaagaacaattggtggcctacctcgttcaagccgtgattgaccattgcccccacgaactggccgttttggaccacgatgttgcgacgttgcaaaagtacaccaagctcccatttccgcgagtttcgtacgacgatgctattacactactccaagcgaacggctttgacgtcgactggggtgtcgactttggctcaccggaagagacatttttggcagaacactttgaccaaccagtctttgtcttaaactatcccaaagcaatcaaggccttttacatgcgggcacacccgacgcgcgatgatgtcgtcattgcagctgacctgttagcacctgaaggttacggcgaaatcatcggcggttccgaacgctcaacggattatgactacttgaaggaacggttactagccagcggtcaagacttgcgggattacgagtggtatctcgatttacgcaaatatggttcgcggtgccgcactccggtttcggtatgggtctggaacgttttctggcttggatcactttgcaagatcacgttcgcgaaaccattccgtttccacgtatgttgcaccgtatttacccgtaaagtcgctccaacctagtgctagtagcattggttaatcaaaattaatcgtgcatcctttaaattccccacgcattttcgaatgtgtggggaattttttatcttatttgttgacaagcaacaatattcaagataaaatgttgcttgtcaacaaaattaaggagctgtttaaaatgacaaaattattaatgattaatgctcatccacacacgaccgtccccagtgcctcactgaccgttgcagcgagttttaaaactgcgtatcagcaaacccatccgaacgatgagattacgacacgcgatctttatcaggacggcgttcccgctttgaacgacacaaccttcgaagcttggcgtaaacaaaaatacggtgaagaactaacgtcagtggaagctgaactacttagccgtcacgccgcctggctagctgaatttctagcagccgacaagatcgtcttcgttaatccaatgtacaatcactttcttccagccgaactcaaacaatacttagacttaaccgcagtcgcccgtaaaacttttaagtacacggtcaacggcccggtcggcttattacccgacaaacacgtcttacacattcaggctgcgggtggctactatcaccaacctgatcagcacaaccaggttgaagcgggcgacccctacctccgtggcatgatgcaactgtatgggattcaggattaccgaaccatcttcattgaaggattggaccaatttccagaacagcgagaacaggccatcactgccgcacaggtagcagcagaaaaactcgccggtgaattttaaaaccggtataataatagtaataaaagctaatgattaattgataattgcgcgctaaccaccacgagaaccagtcgccatgacgcacaactatctaaggggatcaatcgatgtcaatatccacggaacagacaattctaacgcagctcaaaacgattcgaaccaagcgtgcttccactactggtgaacagaaatggttacagcagcatatcaccgaagccaatctacgccgcctgttgccggatatttccatcgttggcctacatttattatctgaactagaggccggtccacaaacgggcatcgacttagccactaacctcggcgtcactcgaggtggtgtgacccgggcagccaaacgactcgtaacgcggggcttaattggctcattccagcaacccgatgatcacaaaaagatcttctaccgcttaacgccgagtggtcgtaagctggcccgctatcatgataagatgcatgcaacccgcaatcatcaagcaatcacgctccttcatgaacactactcaccagcagaacttgcggtgattcaacgcttcttggctgatttgacggattatgaagcttaataataaaaaccaaaaacaccgctacgactaatgcgttcgttagtcacagcggtgtttttgaatttctaatgattagtgattttgtaatcgatacttgcgaattgccataatcaatgacaacgtgttgagtaccaatgataaactgctgaggagtaaactcgtttttgtaatacgcatgagtggcctccattgattgaatttgttaattctagtttaccggtattacgcactaaaagatactaaaagcactaggtgattcgtggattgtgcgatcagtggttaatcatttgacacggtctgtttggcctgggatagcgcgtccttgactgccgccttgatggcacggctcgatacagaagcgccggaaactgcatccacatcataagtgttagcagccaccatttttgccggcaattcggcaactgcctgaccaccaacttcaccagtctcatgttgttcaactacttcaacatgagttaattgttggtcaacatacgtgatacgaaaccacaacttgcccaccaatgccatcatctgagcgccctaagtattggtgttcaccaactgtgatgtccggtgatgcttcagctagcaaatcattggcaccagtctgatgcaccgaagcactagtattcgcatccggcttagccactgctttttcatcgactaattgtatcgtttcttccttaggtttagctgcattttcaccagcgatttttccaaaaatcaggcattcagctaaattaccgccaccttgatactgatttgcacaaataccgcccaactcacccgcaccatacaagtgcggaataggttgctgatttgcatctaaaatttctgcccggtcattacgacgtggtccccttgggtattaagtacgttgtttgttaacttaagcgcataatatggtccatcatcaaatgcccgcatcgtatcaacacgccgattaaacgcgtagtcagtaccagactcgacaaaataattgaaatcatgaacggtcttgggctaagtaccgtaccatcaacttccataactcgtgctaagtcgtttagagtagtggccttcacaactaaatcggtgagattattaatcggcgtatattgacttgctaacatctgttgatactgagtttcatcaaaaaccaagtatggatggacatttgtccgcggtactcgccacattccatgatcataaatgtgaccgtgccggttggattcactctcatcaaaataccgactaccgtcatcagccaccgtaataacgctaccatggttaacttccggccagcctaaaatcaagcgaccacgttcaccttgtggtacggcaatcgaaagaccatgtaaaaatccgagtgattcataattttgcatgtgccaaaagtccgcgccaacttcttgggccatcttaataccagcacccttattaaacagcgtgcctaatggtgccaagtgctcagcaccaaggtagtcctggatggcttgttgattattttcaaaaccaccacatcacatgctaggactacaccattggtagctcgaacattaactaaacgatgctgacgttcgatttggacaccgataattgtattcgtagtgggatcttgaatcaggtgttgtgccggagcactaagccagacatcaatctgttgctgccgatctaacactttttgtcgaagaattttccacaaagctgcatcaaaaatgccatgatggacagttgtaaagtcataggattggactccatcaaattcaggaaactcatgaactgcactgtctaatgaaattggagaatcagcagctgtaaaatcatttttgacactcaccggttcaacattgagatacttttgaacatagtcgcgcatattcgccatgcccgctatgaaagtatcaaccatactatcgtctaattgcatgggtgccgttaagttttgataatatttttaccctcatcgaaactatctaccgttcctaagagttgggcagaataacgggtattgcctccttcatgcccattcggcgctgcatcagtgagcaacaccttcgcatgtgcatccgccgcaaaccgcgctgctgtcgccccggcaccaccaaagccaataactaccgtatcatattgataatcccatttaacctgattcatttttttgagcatgctgaccaccctttcaaaatccatttaacgtattctaaagcacaattgaaattgatatttaaatcacaaatagaatcattttttaactacatctgtattatataaccgctttcatttttatagaaataacaatctgattatctgttattacaaatgagtaatgggttatacttgattttaataagattaagcattaaaggtggcgatttcatggaaaataaattgttagtatttttagaagctattcaacagcacaatagtatgacgaaagctgcacaaagtttattcatcagtcagccgtacattagccgcacaattaaaagtgcggaaactcattttgggacccccttaatcgacccgcggccatcatccacttgaattaacttatgctggagaaagattactgacttatttgcaaagtgacgcccgtctccatcagcgaatgaacactgagcttaaagaaatcagtcaaaataagtatcaaagtatgacgattgggattacaccaccgatggctaatgcttggtttagtcaaacactaccgctttttatcaacgttttccgaacattcgcactaaaatactagaaatcacaacatcaaaagcagaaacgttgctggctagtcatcagctagactttttattggcaaaacaattcatcaaactaacgtcaaaaccatccctttgcagacaatttctttgtctttagtcattccaaaaacagccggaatatatcagtccaatcaattttggcgaccgttcacccccaccattcttacaggaatgactggtgagcctgtcatccgtgcagtcggtgaagctcgctttcaagaactggttgaccattactttaccgatataaaaggcattcaaacgattccactcattgaagtcgataactctcgctttgcactaagcttgacacttcaaggacttggtagcattgttctagccactgcaatgttggcaagactagccactgaaccagccaagtaccctatcaatgcgttcaaattaccaacaagcgagctcagccttgattttagtattgcctacttaccaagtcacgtgctagctaaaccgattgcttatctagtcgaacaagcttgtcaaacctttaaccccgcgattgatttttaacataaaacgcaaactgtcagcatctattaagctagatgattgacagtttgcgttttactttcaaaataaatcaccggtagtaaatcatgttcaaccccaccagctgttgcattagttgctcattttctggtgatagtttgatttgttgctgccgcagacatttggagatgtctaagttcattctgtcgaatactcccagtactgaaccagttcgttgttcccaaatagttcctgataataagttgccagcagctgtcgtaacggttgctcattcgtggtatttagattagcaactaaatcactaattatgcccacagcaacacgtgcccgatcccgccccccgctgtaccatttcaccgtcatatctgttcgactccttttacgcaataacaactgccaccatggtcgctgaacaggtcttctgctcaaacctaataactcatccgtcgagacagaaaatagtttgctcagtgctaccaacaactctaaatctggataacttttccctaactcccacttggaaatagtttgccgtgagacgtgtaaccgctccgccaccgtctgctgggaccattcatgctgttgtcgttgctcttttattttagtaccaatcacaattttcatcctacccgctcctctattaaaatactagactattgggtgcaccaattcattgcaacacacttaagcgctaccgcaacggttggttgcaaccactcaagatcaagtctcggtatgaaaatgttgatacaacgactttcctgaaactaacaattccacaacctgttgaggatcatcaaccgtcacaccttgtcgttgcaaataactgacaaattgcggtaaatagtcgctggccttcaacgcacattccagctgataagtttgggcattagtctttaaaatcaattgaaaataatccggattgaaatcaaatggtgaaagtcgtttgcgacaccgataactgatggtaactcgctgcagatctgtatagtggattagttggcaccgtggacaattgaacacaatttggcgaaacttcgtcaatgtcgatgcagcatacgtatgcaattcaatggtagcgaggctgaatcacccagtaactattgattcccactggaacgaccacaatcaatccaacaatataaagtgataaaaagagccaccacggttgataaccaaaaccagtaaataatagacaaacaaatagccaaaataatccgagacacccagaagtcgcccaaagcttagtcgccgaccaacaatatatggctttggaaagaaagcactaccacgcactaattcatccaaggatagattatacagatccgacagtaccagtaaattatcgattgacggaatcgcctttccgcgttcccacttagacaccgcctgagtcgtaacaaataacttggacgctaattgtgcctgtgtcaatccatactgacagcgacgcgttttcaataatgctgcgagtaacattggctcgccccctttatgatttcagcttaatcctcaaccacgatcaaaccaatcaactcatggttgtttagtcacaatcatgtatggtagtcataatttgttgaacttccgtggttaaatcttgttgctcgccaattaagacttcgttagcaacgcccaacgtatcatgtggaagccaccaccgacgcatgtcttccacaccaaaatcacgatgacgcttttgatgacgcgccaaggtcgtggcaaaagctcacttcaaaataataagtaaggacgcgtggaaacgattgactaagccgcgccaacatttttccataccgatcacgtgctaagatgccttccacaatgactacaggcacacgtcccagcccataacacgcaatttgttcaatcagaccaattgaaatatttcccgggtaatcatgactcatcagcatgtcgcgacgaacgacatcttgggacactagcaacgtatgatggcccacgcgtcgttgcaacgctcgcgctagcgtcgtcttgccactcccagaatttccccgaataatcaccaaagttgtttccatccacatgtcctccactcattcctgtatcttaatcataccgcacagctaacaaaaaaacgttagccaaattagctaacgttcgctgatactatttggctttactggcgttacgtcgggcatcatgtaaaatcttcaatgcgcgtttccgcgattttaagttggtccccgtagacgcctgcgcgcacttgctaaatcttgtttttccatcatgggtgcctcctgataaatagtaattattaccatttaaattataatcaatcttatgcttacgtcaactattatgcagccagctgacattgacagatacaattagctcccaataattaaattatcatttattagactaacggcaatgacaatgttacccttaaattgtcaacgacattatataagtattttgaaggagtggggatctttgaaaccaaacaatgttaataatcagaataaacgtcaccaatcgcgatgggtaatcacgagcgcaaccgccatgatactgacaacgttaacgattgccagtcaggcggcggctgccgacgatacagtcacgaccacaaccaacgaaccgaccaacagtcagttgaatacgaatactcaagttaacgccactcaggtcaatttgaaagcggatacttctacatcagtatccacgataaaatccgaccagtcagcagtcgcagccacgtcacccaccacatcaaccggaagtccctctgagcactcgtcgtcagtgaacaccaacccacaacaacaatcagcaaatccagcatcacaatctcaagcaactaccacgtcagaatcaacaccgaccacagatattaagcactcaactcaaaccgcaccagctcaaacaacctccgcatcaactactgaaccaactaccgaatcaaacactgaatcagcgactgatagtcaagctaaagcaacgacaaccgataatcaagcttccaagcaaccaagccagcaagccgtacccgcgtcgtccaactccactaccatcgaggtgaatactcagtcagcgactagctcagcgtcaaccgatgataaaattgttaccaatgtaaaccaggaaaagctggttttgaaaactaaccaaccagtcgtccgtgccattagccgcaccgcgtcagaaaatattaacgattggatgccgaacacgttattgcaacaagaggtactctcagtcaactgcgcaaacagaacccagatcgtacctggaactcagctgcagacatcactaaggcagatatgctactactgaccacctactatggcaaggacacttatatcgacggcaagacttcctactcattagaaggactgcaatatgccactaaccttacgacagtctggctcaacaacaacttgaacgcaccgtctggcagttactatagtgatgtcactgatatttcaccattagccaacttacaaaaactccaagtggtcaatattcagcaaaaccggatcacggacatttcaccgctcgcaaacttaaagaatttaacggaggtcgatgccgcctataaccacatttcagatttttcgccacttaaaggatttaaaaatctgaaaggcacattcagtaaccaatttatcaccttaccacccgcctatattagtgcagataataatattgcgacgctggcgattgattgctatttgccagatggctctaaggttctcaactgaagcccaataatggcgtcggtgaaactgttttctacaaaaacggtcagctttacgttcgctggtactttaacggtgcgggcggtggtaattacgacagcaacggtcatatctactacacgaatatgaagccccagcaacccggactaacaggtccgacctttaacggtaccacggttattcccatggacgattattatttcatgaccgccgcttctgacggtaacaactttgtcgtcgtccgcccgtatgtcttagctgccactgctgcgcccatcacggtcaaatacgtcgacgcgcttaccggtgaatccttagtcaccactgacctcaccttaaacggaatcgtcggtcagccttacacgactcagcgcattgatgacgagctacaaaattatgactttacgaacattgtcggcaatgccagtggtgtcttcacggcggatgcccagaccgtcacttattactatactcgtaaggacgccggcgacattacgattcacatggtcgatactaatggcaacttagtctacgaaccgcaaattctacctggaaaacaccatctcggtaacgcctacaatttagatgcgccaacctttgaccattttaaattacagcaaactatcggcaatgcggctggcgttttcacgactgatccgcaaagcatcacgtttgtctatgtccgcttagacgccggtaacattacggtgaaatatcaagataagcggggacaccaattaaagcccgataagacaatttccggctcccaattactcggccaagcctatacgactgaaccgttggacattgaaaattacaccctgacgacaacgccggcaaacgccatgggcactttcacagatcaggaacaaacggtcatttacgtctatgtgcgccacgatgccggccagattgttgttaagtatcaagatagtgctggtaacccactagcacccgacaagcttttagacggcaaagagcagttaggagcagttttccctatcaaacggcagccatttcaattcctaacttttacctagtcgccacacccgcgaacgccaccgggaccttttcaaccgacacgcaaactgttatttaccagtatgcgcgctcaaatgctggccatatcacggtgaagtatcaagacgctaacggcacgactttagctcccgacgacatcctaaccggtaacggtcagctaggtcgcccctaccagacgaacgccaagacgattgaaaactaccgcttaattcaaacgccagcgaacgctactgggcaattcagcgaccaagcgcaaaccgtcatctacgtctacactcgcgaggatgcgggtgacatcacggttcagtatttagacgaaaacggcaagcagttagccgccgatagcgtattaagcggtcaaggtcaattaggacagccctatgaaacgtcgccgctgaacattaacggctatacggtaaaatcgacacagggtaacacgactgggacctatactgcaacagccgcaacgcgtcgtttacatttacgaacggacagctggacagccggtcactgccaagtatcaggaccaagatggtaagtctattcatcctgacgttgttcacagcggttatttgggtgacaactactcgaccgaacaactcgctatcgatggttatacctttaaaactgttcaaggcgatgtcaatgggacatttgggactactgcgaagactgtgacctacgtctacgaacggacggcggggctacccgtcactgtcaagtatctggatgagcatggtaagtctatccatcctgacgttgttctcagtggttatttgggtgacagctactcgactaaacagctggttatcgatggttacaccttcaaggctgtgcggggtgacgtcagtgggacgttcggaactaccgcgaagactgtgatctacgtttacactgaaaacacccccacgattccagatacccaaggaatcgttacggtgcattacgtgaccaaggacggcattaaactaaacgaaccaaccgtgctgagcggcaagacgggaaccacttatcaaaccgtgcccctgacgttcactgatcatgaactcgttggtcagccggaaaatgccacgggtctcttcactgctgataacgtggacgtcacgtacgtctaccaagcaactgacacgactggtaccgacgatattattgatcccgaagaaccggaacaaccgactaagccggttgagccaaccacacccgagacgcctaacgaaccaggaacgaccgtaacgcagccggatcgtattaaaccgactcaaccagcggtagctgtaaaaccagcagcgaccgtgaaaccaacgcttaaacccgcggccgcccaggcaagtttggtcaaaacaacgagtcccgtcactgaacactcagcccagttaccacaaaccgacgaacagactggcaaattagcggtcatcctaggactgttattatccatcgtcacgttcgggttctatggtaaacatcggcaatcataacgtcatcaggtctaacgaaaacgacacttcatttttcgaagtgtcgtttttctgatcaaaggtgcctataatgaaattaatcattataattccgatgaaggaagtcctaatcgatgaaagtctatctcattcgtcactccgaaccaacttatcaacaggtcactacagctggattaactggtttcggccgtgaactcggcggcttaaccgaccgtggtattatgctggcacaacaatgcgcccagcagccgttatttgcacaagtccaattaattctgtcgtcccctacacacgcgccttacaaacggcactggaaattgtgcgttttaatgatatcccactaaaggtcgaacttggattacacgagtggctacccgataacacgggtagtcggactgataccgatgaacaagcggccacggcctacaagctctatcgccaacacgccggcaaacgcaccatcgctagtcccctccctttgacgaaacggcagctgaaatgaagacccgagttttggcaactttgaataagtatgccgcatcttacgattgcatcgctcgcgtcacgcacggcgaggtcatgcagcagtttggcgatcagaaagacgtggattattgtggtgtgcgtgttattgcggttaattgacaattcataagcagtcgccaaacaatggtcgcctataatgaactatcaaccactgtcaatctaataataatcaggcttaaaaactgcgaaacaagtgccgacattcgctaccacgccatacagtctttggcaagtactagtatatcgcctatatcactcataatgaagtcatatgtcaatttaatggctgaacacaacttaaatactgtgaagtagaaacgattaatcatttgacatgtttaccctggcctcacaataataatattcatttaataattatcataaacatctagcaactaccgtctcaatacaacttaacttttggcacttaataaattaaattgtaagttagcctcttcattactattgtgttttcctctccgtatcccaatgtcttgattgattgattttcattttttgagcaacaatctcaaatggatcaacctgtagcttttcacacatataaaatatataaattaacgtgtcagctaattcttcttgcaaatgttgattttctctattatccaacttctgattagcattatgccactgaaaaatttccaaaacttcactagactcaatgtttagagaaattgccaaatccttcaagttatgatacttctgccagcctttttattacggaattcgattaatgcttgttctatctccgaataattcaattaaatcacctcaaaatatgttgatttccagctgcccttagtaaggcctgttgtagttcctcatcgacagcaaaaatatataacccatggacaccacgagttaataaaacatttagttcgttacgtaacaattcttcggaaacgtcaatttttgatgtttccatgttcgttgattcgtggcttttttattcttactagcttgtttatcaaaaattaactttccgtctcgatacttcactgatgggccgataatcacaccagcataattcaaatcaaaaccttggattgtaaatgttgagccgacctcattaattgtttgaaactgttcggcccaagctagccctttgtttcttcgcttttcttggcgagaaataggaatctgcaaattccatggcaaactccacgtcccaatctttactcgccaacagtcaccatcttttggttttcgtttctcaacatatggccaatcaaacgttgccaacattctggcaagactagcaccgttactatttttcaatcgatctagtgccttgattttagcgtgtagtttttccggagatgtcgcgattttaagttgatattgtgcatcatctggaattacattaatgcgcccatcaattgcaaaatttcgtaaccagtcaatagtacgctgctttctcggcaatcattcgttcctgatgtgttagctcaattcgattgccttcacgttcagcatcatcttccaattttcgaacagccatgtcgtccaagtatccctcggtagttagtatttgatacttatcaaacacaataactaccactttggctaactttaataaatcctctagctgattatgtccccgatatgccatctttccctgagtcaggagtaaatgagcttcatcaactagtacaacatcaacttttgccgcaccagtatgtttctgaataaaatgagtaggtttggagacgatgtctttatgttcgtgatccaaacctaatttatgtgcaatcgttttataaactgtttttgttgatcgtgattaactaataaatatactgaatctttccgcactaaactactattcgttaagtcgtaaaacaaattactcaacaacacggttttaccagttctgcctgaccggcaataaagattgtcttaccgcgttccgtagatgattccttcagtgcagactcgattttaccaaaaatctcattcttactttcatgctgttcagcatttaaagagtggaaaggtgacgctttgaacacagcagaattttcaatttctgatttttccggaaaaatctcaggctttttttcctaagcgtttgccagactccttcaaacacattctcaaactgatccgacataaagtattttcgctgcggatttgagcgtcgattattcaattgagtaacactctccgcacttaataaatacatcatcaatttattttcaatgtcgagcgttagggatttgttaaaataatagtccccaattacaatcatctgtgaattatgactctcatttaatgctttccaatccatccgtgactttccagtatcttttaaatgctgtcgtgttcttctacttatgtcgttagtttctccaacataaactttgaacttagggtcattactactgcggccagaacctaatttatcataaatgtaaatagactgtcggatattcaaatatcagctctctattctgcatatctctatgtaggctaacattataaccagtattatatggaacaatttctacaaccggctcaatgtcgccaatgttttcttcaattttgttgtatcgcatatcttcatcctcgtgttaaaaaatctatctggctttattatacatgaaagatcaagggacaaaagagcttaccgcacaaactaaaaaggtagcccgcgctgaaacgtccagcaccgaactacctttataacgaatattaacttattttacaacttccgcgaccgccgcattcaccgcatcacgttcatcttcaactaaggcaacgcgactggcgattaccttagtatccatcttaatttcacgcgttaaacctggcgtattgatttttggttcaaagaacgccttgaattctgctaaacgttcagccgtatggaagacccgtgaaatgacggtgatgtaagtggtaaattccatgtgtcaccaccaaccgtggcttccaaccatgaccattcgtcgcgaatccaatcccaagctgcttgttcaccagctggattagccaagacgccgcggaaccaagcccgcaagtcttgtggcttaatcgtatccgcatcttcaaacttcacaactaactgtttgattaattcaggatccgtagttgcggtcaatgcgtcacaaatgtcagccttgtaactagcatcggctgtctgccgtgacgccgtcaataaactatcgaataagtccttactaccaaagttcttgacttcattccgtaaaatgaagacccgcacatcggctggtaaggtcgctaacttatcacggttaccttcgaataattcatgggcagccaatacggccgcgctattcttggcgtacaaagccgcactcaaaacgtatggccgcgtcaactgatcatcgttagattcaccagcttgtggcaaccacctaaccgtttaacctgagcggcactcaattggtcaaaataacgtttgtaaatgcttttcttcatcagaatctggcgtaacaaacttacgtaagttacccgcaacttggtacaacgctgcgttaacgaccgttgaatggctggctgcaaaccggcttaataatggcacaacggctgcgtatgagatttgacgaccttcagctaacaagcgtaagtcttgtaacaactgtaactggtcaatagcagttaagtcatcaacatgcgctagaatatcatccaataacgtttggtcatacttgacgatgaagtgggagttattcccaacgttcaagcggaatggttgcccactcgcatcacgtaatttggcataatcgccgaccgtcacagcttggtccttcataatcgctggtgccgcctcatagttgctattcaacggaatctgccattgacgaccgacttcttcaccttcaccgatgaagaactgttgttgcgacaaggtcaactgaccgtcaacaaccgctgccgtgaccactggagtagccaggttgttccagccatgaatgcatgatgtctccaacttgcatcccagaagcatctgctaaggcgttccacaagtcatcacccttggcattaccatatttatgattgataaagtactgcttcaaacccgctcgtaaggcatcatcaccaactaaggcccgcgccattactaacatccgcgcacccttagcgtagacaatcgcaccgtcaaaaatcgagtcgatttcggccggatcttccacctgaacgtggactgactgaaccccatccgtggcatcccgttgaagcgccattgatgcttcggacgtttggaaagtttcccaaatatgccagtctggttctaaggcgtccgtcgccacatattccatcatgttggcgaaactttcatttaaccagaggtcatcccaccacttcatcgtaaccaaatcaccgaaccattgatgggcaagttcatgggcaatcaccgtggcgacccgttgtttcgtttcgaggggttccgtgttgtcaggatctaatagtaagtaggcttcccgataagtaactaagccccagttttccatcgcaccagctgagaagtctggtaaggccaattgccatgagtgtggcaatggatatggcgtctgataaaaatcttcataaaattcgattgagcgcttggcaatgtccaaagcaaagtcgagctcgttagccttgtgggccttagtaccgaaaacaccgatggtcacgccactcttggtcttcgtctgcttgccttgtaattcaccaaaggcaaacgcaatcaagtaagtcgacatccgcaccgtggtttcaaagtaatgcactccatcggcttcatgatcttcgggcatgttgcttaagatcgtttcaccatcatgttcatcgtacttgatggcaagatcaaaagtcgctttagcttctggttcatcgacacacggaaaggcttgccgggccgcggtcgtttcaaactgcgtcccgattagttctttcttcacaccgttgacttcgtaatatgatgggtagatacccatcatcgtatccgtcaatttggcactgtacgtaatcgtcaaagttgtttgaccggccttggcaagttcaattcgaattccttgaatcgcattatccacagtaaagggcacgtccgcaccatcggcttggacaccagcaatggtcaaaccattctgatgaatcagcactttcgcgccttagcatccccggtaatcgttgatttccccgaaatcagcttatccgcccggttaatattgatataaagatcgtaatgttctggttgaaatgtttcgtaaaaatgagttgtggttgccatattattctcctcgtttttaagaatatattcattatacgacaattacgggtggaatgcgtcctctgccgcccatgaatttgtcacgcgactagcaactaattctcgacaacccccatcactaatgatgacacggttccttgcaccgtacgatatcgataatcattagtgcgaaacgacgatattacgccgcttgtctaaagtcatcgataatttcttcaaactccgcatccgccaacaccggctgccacttcagcgactgacccaccggctccaacatgatgtagcgacagctatagcggcgttcgaattggaccgtggtcggcaataattcaacatggcgcgtgtcgtcttgaatccaggctgtgggcaaccaactggtcacgcgactagcatcgacacttaactcttgcaactgctcggcaaaccttgtccgcatcagtaacggcgcgtccattggcgaaccggccacgtcaatggcaacttgaaaatggccgacgtatagcgctcccaaatcataaatcaaacgttcatgcttatgtagcgcaattgcaccggtgactggttgccacgtagctgtcgctaaggtagcctgattgatcttggtgaccaccaaataacgtcgtggctgaatggtacgggtagttagtggtactgatatatttgccttttggtcagtaatttaggattggcagtaaaacattggtcagtaagcttatgaaacttgtgatcatcttcattactaaaagtaactgtcatttttaaccccatctctatccgtctaagttgctaccgaataccatcttccaaaatctaatcatgaaccagtaccacgacctttcactcgtcagcctcacgttcgtattaagccgcttctggctcccagcgttcaaaagcgccaatcagattctcagtcatctgtaactcgcccatcacgttgactagtgccgactgggcattcataaagagtgtcgagtgcacaaaccgttgagccttggcattctcgatcagtcggcgtacctgtaaccgctgggccgtcagcaattcagtttcggcctgacgtaatttttcacgcgccgcctcgtagcgataggccgcaatctcggctaaggcagccgcaatcattgaccgggcgctgccgattttcaaaatcatcgtcatcgtaaggttgagcgtgtgttccatatttttctgcatgtctacacctttttttctttagatttcctactctttgaccaatcgtacacacttgtgttgacggtaatcttcatcgtcgcgccattccccaaatgacagcaatcatgatcgacaatcagctttaaaatgtcgtgccgttcacatgaatgcgccggccgttagatgtcttgacaccgttaacttatgtcatagtatagcattattttcagaaaacaattccgactttttcaatatatacataaactttacaaaatgaaaaccggggcaatttacgtgcatttgtcccggcttttatattaatattatattttcacagtgattaatttatccccgcccgcactaccgatcatgacaccctcgattaatctaatgagtcagcggccggactggtctttgattcatctccatattgccagtcacgcatttgatttgccgcggctgctgaaggataggcgttattatcgaaccaggcccccagcaccactagcattcattaagactggaatttggcggccatcaaaataatgataacgcacgtattcaaagttaccggccccagcagtctgctcggcccccataatatgaatccatttttgtccctcagctgccgcataagatagcttcaacccgtcggtatcattttgcgtcatcgaattaatcttgtgatcgtacttattatagtaataccaagtcccctgataactttgaggccattgattagccttcgcatcacgactcatgttcacgttcagcgcactatctgtcagcgtcgtcggtcgactgcccgtaatgatcttggcaaagccggcttgcaaagcactgttctgcgtgtcatgaatgatcaactcgtccccgttggtcgtctgagtcacaaagacgactggtcgccgatgatggaggcaaaagaagtacgtgtttggatattgtgcttccgccttaccacccgttgcgacggccaccacttgaaattcatctacggtcttcgccgtccttggaccacttgagatccactgactgcgagccccacttgattcggcccgctaagctaccattaagcaaagcattgggaaaacgaaaacctaaatggtcaggaaccttgtcatcatacgtcccgacataggtctggcccatctcgcgttgccaagcggccataaacgttgataaagccgcttgcttgcccgtattccacaaggttgcctcagccggtgatgaagaatcactgctagcggtactttttggctagcagcccgctttgccgctaccttggttgacgttgatttttgactcgtcttgggcgctgacgacttgggcgacgtcgtgcatcccgctaataataaacttcctaataataatccgacccacactttttttcatgttgctcctcaccggtcccgtaccggtatcccctattcaataattacttttatggtaccaaaaaagtcggcattgtgctgggcgttacaatataaatgcttcacccatctcacttaccgactatggctatttacttaatcgtgatatttaacgtccctaaatgtgtaatctgaccgcacagttgatcgccggcttgcaaaaagacttggggattgcgaccaacgccggtcccactaggcgtcccggtaaaaatcaaatcacctggttgtaactcacagaccgtcgacaggtagtgcaccaaatccggcactttgaagattagttggctcaacggcgcttgctgcatcgtctgaccattgacggtggtcgtgatcacctcatcgtctaagtgagctaactcatcgacggtcgttaaccacggcccgactggtgcgtaattttcaaacgatttacccattgaaaactggggattatcattctcgaactgaacggctcgatcagataggtcttcaccaaccatcactccggccacgtgcgccattgcatcagccgtcgcgatatcgcgcccacccttgccaatcatcacgactagctcggtttcccagtcggtctcaggaccatgcgtcgccacggtcacgttcgctggtgccagtgaactactaaacttcgtaaaaatacttggaaccttcggcagcgtaatgtggatctccgccgaatggtcacggtagttcatccccaccgcaaaaatctgttgcggggccgtgattggtgccgctaattcttgcggcgcaaacgtttcaagcgagacaagtttccggtccgctgctggcatatgtagcgcttccaaaactgtcttcgcatttaaaactatttgtccatgctgttcatccgtaatgataaacggtcggttggcccgcatgccaattttcatattaatcacctcattgatattattgtacactcatctcatgaatcataacaataatgatagttgcgtgacggtcattccggacaatcttcatgaacattcaaacgcaattacgaacttagctcaggatatttcttcatgtaacgctcatcactaaaaaggtacccgcctaatttgcgagtacctttaaccattacggctgccattaatgtgggccgtcatcctttggttctgggtgtttcttttctggtgctttttcttgcttgtcattttgttgccgccactcttctgtcgttaacatgtctttaacgactaattttaacttagtcacttgataaccagtcattgatttaacggccttggcaaccttatccgccacccgtgctagaatctcctgaccattcttaccataagctagaatggccgtcaattcaattccaaccgtctggtcatcgtcatcggtatccactgaaacgccggtctgcgggcgatccttatccgtaaagcgattggaaatatcatcaatcagatttccctgtaagctcaataccccttcaacttcttgggccgtgttactagcaatctttgccaataccgtatcgtcaaaaacaacttctggttttaaagatgtcgctgttgcttccatcaaaattcctccttgttttgtccccaaaaatcgtcttaccaatgactactctaaacgaccgtgctattcaacttgccgcttatctgttgattgatccgtatttggtttgccagtggcctgatcttgccaatcacgtttactcatgacgtcactgacatgtaccttaatttcaatgaccttcaagccagtataccgttcaacatcttgctgaacacgttgacaaatttgattgaagatttgtcgcatgtccttaccatattcaacgatcatcgtcatatctaaagcaacttgtttcttaccaacttgggcgtcaacccccgcgtcgggtcagcttcatcacgaaagcggttcgttaaattgcttaacatgccgccttctagggataacacgccgtcaacattgcgtgaagctagaccggcgattttttcaatcacaccgtcatcaaacgtcaattgagtctgtaattgttgttctggttgtgccattgtaattcctcccattatttagataaatactcactctaaacttctgactaactgcagccaaatcgacgtggacaaaccgtccaatcgcccagccgatcagccctaaaactgcgactaataagactgccgaaaaactggttaatacccagacgatacctaaaagcagtccaatcagaaaaccatactgtgcgttactcatcaggaccctcctttacaccacggttaacttacgctggtgatttgctggcttaacttgcactactggttgttcgaccgtcaatcccaattgattcttcaaatagtcctgtgccaaggttgccgcctgttgggccgtggtttctaacgatgcgtcagtattaaccatcgcatcaatttttactcgtacccggcgacgacgccgtaatttcaagtgaacctcaggatcaatcagattcaactgattaacgagtcggtactgcaaatcacgttccaaagcccgttgcggaatcgttaactggccaaccttgccatcatacgtcaacgtgctgactttaactcggtcgaaacaagccgacaattaccaataagataccaacgattccggcaataatggcaaagaccatcaataagatactccaaaccattgggtagttaatcgtcagatcagctaaccaggacgtcaaccacgggatcgggtacaactgacccagttcaaaaaccgctaataacaccaatacaattccgactaacgtcaccgtaaacttagctaagcggctcatctaatcaccgcctaacgtttcttacgcatgccgaagattgcagaaacgattaatactaagataatagcgcctaagattgagggtaccaatgccataccagctaacgaaggtccccaagttccaagcaatgcttgaccaatccaggcaccaactaaaccggcaataatattgccaatgatccccattggaacgtcacggctggtaatcgcacctgctaacgcaccaatgacaccaccaacaattaatgaccatagccatcctaacattctaatcactcccttacagttatatttgagtacatgcttatgataaccataatttaatttcgggacaattaatatgcacactggtcgaattgtcacttaaaatctgaacaattaccatcaacgaatcccgccgcttcgcaatttaaccacaaacataaaaaaatcagcctcgccaattgttacatcgcaagctgattatttctattaaattgactactaataactgctctgacttagctagattaggctggtttagccggagtctgtttggctgccgtcaatgcttgattgattaccttggcgtataaaatatcaccagcccgaatgccaccgaaatgtacgccatccgtccctttgaaaacttctggatgttgcgccgcaatcttgccccagtcggcaaccgtaatgaacttatacttagctggcagacgccgttccaaaacggccaactttgatgaattccagtcagcatcggcccgggcattataaggtgtcatcagaatcaacttgtgtgcccccggctccaagtcatgaatgatcttcatggtttgttcttcgtaatcatccagcgcgttggtcccaatacaaatcaccacgtactgccgtaacgtatggcttcgctgctggttcatcatgactttatatgccaggttcatcgtccgatcgccctccgcatcaatattgctgttcgcgacgtgatcgcccaggtagctccgcgtccccagcgtgacactgtcaccaataatggaaacgcctggtgccttttcttggtcacctttaggcgttgctcgcttcttcttgggcgtcacggccgcgagcacagcttcatgagtcgttccgattttatcaatatcttggtaaatcccgctcacccataaattctgttccagtgtcgaaagttgcggcgcatttttgactacgaccccggtattaactgccaacaacactctcgcggtgataacgggtaactgcaactgtcgccacgtcactgtatgaccgaaaacgtgggcgcgtttgcccgcaatcactggttctaacacgtagtatgacaacgcggataggataatcgacagtaccgtcgtgagcagcgccgccaaccagttgaccatcatgtgtgaaaaaatcacgtacaacggccagtgatagagatacacgctatagctcacatccgctaagaacgtcatccaccgcggttccttgaggttcggcgtgtgatcatgcaacaaccgggcgccatagatcatgatgccagcgagtacagtagccagtaacagcccaccctgatacgtttgtagcgcatcgaacttcatccggtcgcctaaagcaactaacaagataaaactaataagcatcaccgcgcccgcaatgatcggattgcagtgcgccgtggtccaacgatagattggcccttgagctttgatgccgctcaggacaccgataagcccgccgacaaagaacggaaaacagtgggtcagacttgaaaagtagactggtgaaaagtcctttaagccgaccgcgccaaagtacatcatgacaaagctttcaatcgcaaaggcagtggtcaacagccctaagccccaacgaaaacgggtcaatgcgcgccgaccactcgccaaccgccgactgattttagcgaccaaccacgcaatcaggccccataaaatataaaagtgcatttcaaccgctaatgaccacgtatggacaaataagtgcggaataaacttgttttcataactgccacccgtcgcaatttcaaaataattagtcgtaaatccgagagccgccgcgacgaccgcttaccaatgtcggtcacaaaatcgtgatcaatcaagtaagttagcggtagcaccaataacaccgcaataaataatggtggcacaattcgataaaaccggcgaccatagaaagccattagtttaaagttatccgaacgagcaaactcgtccaccattaatgacgtaatcaaaaaccctgagaaggtaaagaagatgtccaccccgataaagccaccccagtaaactgggtttggaaaaagtgatacgtcaataccagcacgagtcccgttatccgtactaaactaaaccatttaatccgcattttctaacttaccgtcccccgtaatttttttttggcataagtcttgttgccgacccgcagtttgaccacaccattcaacgcacccttgctgaagttgccttgcaagcgccacccgttcggtgcaatgaattcgcctgggccttcaaaccggccattggtaaaattacccacgtagcgcccctgtttgttaacccgcaacgtaccctgaccgtcaaacttgtgcttcaaaacggctccgctgtagctcatccgtccgtgatccaattgcacactttgctgcttcgccgttgatggtgctagactgataacggcaaaagtgacaataccgataatcgtgataatttcaaagaccattctgctactgatttttcccatacctctattcctttcacaaccttaattccccttgtaatccaacaccacagactctcccattcgtctacgggtttacacagaccatctcaatcattgcccaaaaacaatgatttacaagtaatagcacatataaatttgtttaattaaataattaaaacagttctaatagttatactaattaatatattactaaatattcagtctatcgggtagatgaaaattaccacttattgatttttcaccatcatctacgtcaactttgataaactcaactaaaaatcaatcataactactctgagacacgaaaaagcagtcaactcatcgcatttgactgcttttttaagtaattactttcatcgttacagcaaatcagttccagtcacccaatttgccctgagcaacatatcaacaaagaattgacaatatctcaaagtaaccgactccgtctgagcagtactatgcacccttgctgatgggcagcgcgctacacgtatcatagtttgagaatttcattgtcttttcttcaatatacactacacatttaagcatgtgctaccgactgaccatccaattagtgaccgccttttgctattatgcttactctttttcattagctgctgaccattttgtattgataatactttttatctttagaaagtttagcagtcgctccattagcggttttgccctcaaaggttacctcattatcttccacattaaatgtgccgctatatttgtccctgtaagtttttttatgtcccaacacgtcaaccgtttttacgactgtttctttatagtttttgccatcaaaaacgatcgtatcggttcccaattcttcacttgtacttgtatacgttccccgcaaaccgcgtggcttcagtgcaattatggcaatcacaatcactacaataccaataataacgccgatgatacttttcttagaaactgtcatctacttcctccgttgctgtatatacttatttacccgcatgacgatcattcaagctttcatttttattaattcctggcaattcgaaccaaaaccctctttaagtttcacattctcagtctctcccagagtaggcgtcccatcccggctttgatcaacgagcacgattgggctgtcatttctaaacgcaaagaaataggtaatatggttaggcagtggcggctcggtcccatcgtggttgtaaatcgcgacaacgttgtattcatgtgtgcccttaccactgggtgcccaggcaatcgaagcccgttgtcccttgacgatgacatccgacaaatcacgcggatacaataatccggtcgaaatgtctaactcatgcacgccatcatacttggcataatcctggttcattgtctgtgaccattgcgtcataaatgcgtctaactgcttgtttttgctagtattccacagcacaccgtctttctgattagctgctgttgttgaactagtgcttgtcatattttgtgcaaagacacgcgtataattattattactagtccaaacggtaattaaattctgacggttagtgcggctgccagtaccgtcaacttgataatcactagtcgtaccggctggatagaacgtcattgcccaattactaccatcatcgttttcagttgagacactgaatattttgccattattacgaagctgggtaacctcatttttaccatcaaccgcaatactatttttcgtgacggtcaacgtgccagtcttaatcttatctttagctatcgataattgcccgttgacctgactagtatcaaattccataccattacctttatgatagttcactttggcaccaatcatcttccagtcactacccgtcaaactacgataattgccggttttaatttcagccaggttcatacacgttccggttgctgttgtcttgtttgtttgtgaagatgccgcgagacttttgcgtgctgatgaagtccgtttacgcgttgtcacactcattgacgaactcgatgcgctagccggactttgcgcatttttcccgccgcatgccgacagggtcactaacatcacgatactcgtggtactcagcacgaattttttcaagccattcatcattatttccgtgaattcaacgccgaaatcgttgaagaaaccgcagcaattccggaattgaccgccgttgcgtgcgcattagctgcaatatctgcttgaagactcttgatttcttcctgtgctgccagctgatcttcttggaaatgctgcgtttctaaaagattgaaggcttcttgtaaatcccgcgctcgattttcattcactaacttccaaagccgtaacgcatcccagtaattgtagaatttctctgggaacccattggcctcttgttgataaactggattagccagctcttgttgtaagcttgcttgatcttttgaatcacctcattagttggtgacagatagtgcagatacttgaatacgaacaacccgatggcaatggccgcactagtaatgaccaggctggcgccactttgcaacagtaacgccgccacagccaagataccgaatccaataatcgttttatggaaccgtttcttatccttagctaatttatcctgatcagcggccagcgcctgttgcgcactagctacccccgccgtagcgcttcgcttatttttcaaaaagtccaaaagttcttccctcgtcatttgctactttcccgctttctattccaattttttattaaattcgcttacgacgcttagttacacccagtaacccaactaatccaatcaccatgagtcctagtactgaaacagtacgatcagccttttcattcgtttgtggtaacgtgctagttgatttagtggtagccgcagccattgcggctttccgttgttgcaaggttgtggcacgctcagcactcaacgcgcgatgtgccttcaaggtcaccgtgtcaccacccgttgtagcgtgttcagtacctaatgcgtacttcgtattcaatgtagtaccgccaccattagtcatatcatgttcagtatttgtcatactttccccttgggccgacttagactggctcgtctcctggtttgtacgatcaatggcgtcattaagtgctttagtctgcaataactggtctagtttagcttgcgccgcgaccaatacttgcttagccacatcagcaacttgttgtaattgttggtacgtcactgcatcactgtcctcagttgtttgagcaaccttaagcgcttgaaccgcctggtcataggccgcttgcgcatcaacaacggcttgcttagcggctgccaaattagcatccgcatgcgtcagtgaatccaaatacactttcttattagctaacgcttgttgcccagcctttagcgcagcctccgcattcgccaacttgaccttagcttgggcaagtgcttgattagcggttgcaagtttaaccttagccgcagttaagctcgcccgcttttgggactgaaccgcttgcgcagcttttagcgccgctttggcatcactcaatgcttgctgcttagtggcatcacttgcactagtttcatcaacagctttttgagcagcggcaaccgcagccgttgccgttttaacagcagcttgagcgttggttaaggtagtttgggcattagcttgttgctgcttagcggttgctaaagtagttttagctgcagttaacgtattctgggccttggtcgtattggtatttgccgttgctaaagcagtcttggcggtattcgtagccgtcttcttagtggcaaggtcgctttctaattgcttgatttcattagcgctgactgtttcatttttaatagccgtcttatcaaatttactttcgtcgacccagtacgaagaatcctgaggaacaaacgcgaagtgagaatcaaaattaagtgttttcccggagcacctaggacattctcaccaatactgtcgctaaaggacacaccaaaatactggtctttacccatgagctgcagcgcccaaaatgctattagcatggctccattcttcgtcattagccataaatgattgtaacgaagtaaaaatcatttgcttaaaatcatctaaggttaaatgccattcaccgagattagatgtcgcttttgcaagggcagcatcttcatacatgttagcggttgcctttgaaaacagtccattcttagcggcagctcgattaattgctggaacgtcatgggcattttcaaccgctaatatccactgatcagcagtgacttcatcagcaatatcaccagcaaacttgacactaccatttgtaacaatgacatgtggcgccccaaattcatcccgcatcgaattaattagttgggcggcgtacgttgataattggcttaatacttcgggagtcaaatcttggcgaccattgattttgatattcttatcgaccgcgctcgactgaaatttaagcatctgactcattgcgtcagatgccttgattaggcgctgaacaacgggataactactatttagattgtagccttccgcgtcattgtatgctttcaaagcattaacatactccagtacctaaagtaaaagtttgggtgctccctgatgttggctagcgtcatccaacgccttttgcgccgcagcttgtgcttgtgtcgccgtattaatattttgttgggcagcactttgggcttgattagcctgatcaacactcgtttgcgcactcgttactttggtctgtgcatcactaactgcttgactggcacgcttcgttgcatcattagcccgcttaacattggtttgcgcttgacttagatcttgttgcgccgttgccaaattttgttgggccgtcgcgctatctttgccgtccacaacgtcttgggcatggtcgacttgtgcttgcgcgttagcaaccgtttgattagcttgcgtcgcatcagtattcgtttggtcgactacagtttgggcgctattcacactatcaccagccttgtcaacgtccgttttagccgtatcaaccgtttgcgttaattgctggttttgattttgttggttagtcaccgcgtcttgtgcccttggttaatcgcatcatcagtcgcactatctgcaacttgttgtgcctcggcttcggcggtcttggccgtactcaaatcagtttgcactttagtcgttgttgcttgcgcagtcgacgcttggctttttgactgtaccgcggcccctttagctgcatcagctgccgtttgcgcctgccccgtcttatccttggcatcatttacagcagtttgcgcatccttaatgtttgcatcaagttctgattgactcgtcttggccgtttgcgtctgccccgttgtcgtattattagtcgttggattggtcgtatcggcttatgcagtcgttgcagttccaatcgccgttgcgcccgcagcaactaaagccgttgacatcaaagcaattcgcgattttttcataataatttcctccaatagtcttacatcaacaaaacacactataaaaagagtattaagaatccttttctagcatttataatatcataaagaacaccattttagcatatctaatactactattgtattttaaacactactgttttctataaaatgaagttattatgacaatggaatattttggtgacaaattaaaatcattaagaaaagcaaagaagctaactcaagttgagctagcgcaacagctcgacatttccaaatgggctattacttcttatgaacaaggaaagacgtaccctagtattgaagttttaatcaaaatttgttcagttctcgacacatcatccgattatttacttggaatttctgacaaattaccggttaagatgagtacactcggttttacagatgaggaggtccgattgttgctacagttcttaaatctatttcagcaaaacagaacacccattgataaataatcatatcgatcgttaatactttcactcatttacccataaaaataacctgagttccaaatatcattggtttgatatttggaactcaggttattttatctgcttactgttgaataagaattcaacgctataaattacgcatgcttgcgtggcttaactaaaccaaatagtgccaaactggcggcaaataatcccactgccatcaaactcgatgactgtttttcatccgtttttggtaaagccgtggcctgtgcggcaactggctgttgtttagctcccgcaaccagcttagttgttgcatcgccatctgaaacatctacgctagtactcgtggcattaatggtaccattgttattcgctacggttttagtagctgtcgcatgtggtgcggtaacaccagtcgattgagcaacatttgttgtttcagcaattctatcagccgcagcagccgtcgtcgttgtaaatttgttagcttcgacgcgtgccaagaaggctttagtagccgttaaatcaccttgtgcaacggcgagatcaactctggcagcgccgagcacccgcttaagttgtgctaaatcggtctttttacgatccagttgcgcttttccagcagcaagttgctcgtttgctgtatcgatcgacttgagccgccctgcgcgagcatggccttggcaacagcgatttgttgttcagccgtagcaatttgggccttcatgcttgcaatccgcgcgggcggggccgcgatttcggccgccaatcgggcgttttcagcggtcaaatcggctaccaatgtcttggcactggctaagtttttagcggcttgcgtggcagttacttgcgccgcagccgtcttcgcgattgctgtcttcaaattacgaacgggcgatagttgttgctgttgcgccattgctaattgcccttgagcttgcgtcaaagcaacattagccgctttcaaactagttgcagcgacttgaacttgggcctgtttagtcgtaacagtcgcttgtaagccacttgtctggttttgtaaagcttgtaaactggcattttggttagccagcgtggttgctaatgtcttcccggtattttgtaaaccatttaaactagccgttgcagcaatcaacgttgcgttcaagccgccgcaatcttcttcggatcagcggcggccgtctggacgtaattgaacgtgacagctggtaaggccttagtcccagtagcggcattcgcatgggcattgtcgaacaaatcaacatacttgtcttgctgtgcttccgtcatcccggcattatcgacttcaaatgccgccacgtgtttggccaagttgatggctactccggcatcaccagtcgagtatattaggttgacgcggtgaccaaaggaaccggactcaatgttattggattcatcataccaacccatcacagcattataggccgtttcttgatcgctcatgaaccattgcggataaacttgtgttaaattttctgcataacttgagccagtatgatccaagccaccgtcgacttgggaagctgctcgcgcaatcgcattattttgcaacgtcgccgtctgtttcaatgctggttgaccattcagcgcccgtagctgattgatatattcaaacatatactgattgatgattttatccgcattaggcacatacttgccattacttggataggcgacgctgactgtttcggccccagtcaattgagattgtgggaattcggcagcgtcatacttattttgcgattctgtcgtggtcgttggccgttctgctgccgctaaagctgcttgagctgcggtcactttggcttgcgctgtggaaacagcttgattattcgcattaatttgactggtcgtattttgaatcgctgtcttggcagaattgattgcctgggtatttttattaaccgcatcttgcgctgatgctacggccactttagcttgatttgcttgggtggccgctttttgctgggcggcagatgcttggtcaaccgtcgcctgtttagcggcagtgacggcactggctgcatcggcatcagattggaccgtggcctgttcagttttagcttgcgtcaaggccgtgtcagccgcgtccttagccgtttgtgctttcttctcggtagctggctggctgagttggcgatagcgactttgttggccgcaatttgctgttggtcagctggaatttgtgtttcagctgctgccgtttgcgacttagcagcgtcgactttattctcagcctcagcgaggacctgattgttagcatcaagttgttgttgtgcacgatcaactcgggctttaccagcatcatactgggactgcccgatcgcaactaattgactttgattagtcacttgcccctgcgcagtcgccactttagcttgtgttgtattgacttggttttgagccgtgactacgttccccttggcagtctgcacgttggcttgatactgttgctgactagtcggtttgaccgttgctaacttttcgttagttgccgtctgagcgctccccgcgtggcactcgtctgattcgtcgtatcgctgttatcagttgccgtgtcggctgcgcattgttaacacccaattgggtccccacgaataatgccgcagtggtaatactggtatacaataattttcttattcataaactcactccaataagttaatataaatatcattataaaccaatgatgccataatgctagatagtgtttacacccttatgtcctgattgaacattggaaagccttatttaatcaggactattatgaattttagtcgttgaataagtcgcaaatcaggaaataccattgttccaattttacagtataaagttattttaataatcaacaattgctaatcaaacattattaatgacgttaccatgaccaattcctatctattattaactcagccctaccaaaataggcagcgcccaaaatttggacgttgcctgttttaatcattacacatcacgcgactaatacgcgaatgtcaaccgctatgtcggtaggataacctgtgttaacgtgaaagcaaggtcaacatgccaaccatggctaatgaattattgataatgtgcaaggcgatactatagcgaatatcgttgaaccacacgtacgtaaaagtcagacacgacggcgatcggtaaataggctagtagcggggctaaacgataacgtatgggcaagggcaaatactaaactcgcaaaaactaatgcaaccgtgaaactcacccaatttgtgacccgcggaaataaccaacgatacatcagcccgcggaaaatcagttcttcgacaatcggtgccaatactgccatcatgacaacattaatgactggattagtagtaaataccttatccaaaatcacttggttttcaggggtttttttcacgataagtcccgccaacacgttacctaactcaaccaggataaataggcccactatcgttaacaccggacgtgtcggtcgtgataaactggtcacgattggcgcttgacgacgataaatcgttaccagccaccaaatgagtgatccgagcaagactaaacttgccactccggcaattagtgttgccgtggccgagaacccatgtcgaattgctggcatcatcgttggaatcatagctaagttgatatagtgcgaatagaccaattagtttaacgatattgaggagccaggtgaccgttcgattagttgaatgcgattttgacatattaagcctcttctctatattttaaagtgtattggagcatcttctattgatgtcattttaacgagccgaatattttttccttccgaccttaacagcaataattcattattaatgatatatcaaacacaccccaactatcacctagaaccattccctatctagagaaatttgacgacctacatgaatacgaactacaacaatacactgttcagattagctaccgaataagtaagctaattgtcccaactttttagtgtgagttctgttctatacaacttaaaaagtaacaatcaataacttcttaattatccaataatggcaactcacgagcggctacctcagcataaggcttactcttgagccgatggtaatcaccaatcaaataaaaatcatgtctagcacgcgtcactgcctggacattcaataaattaggtttactaaatgcccagtcagcgccaccgtcagtatcttggtcagttccaataattaggaaaacaacatcggcttctttaccttgaaatctgtgaacagtgccaacatgttcttgcaaccatttcttagaaatcgcaccgtcattaaattcttttggcaacttgttagtaataccgttgaccactgcacggaagggggaaataacaaacatttgatccaaacttttgccttcatcacgccgctttttcattattcgtgccaaagcagtcacattttcagggacgaattgttgattcgttgcttttccttttgagttaatccagcgactacgttcaacctgagacagcttcgtcggctttccctgaaccatcttattctcataagaaatttcatttgcaatttcaaacatcggtgaatcacagcgacgatgaacccataacggtattccgacccatgtatgattggacctatgcataccataaatactaccttgatccgcaagttgctgcacagacgtcgtcggcagcaaatattgttctgatactttgaaatcacgcgcaatcgttcttaacgtcgcctcattagtcgtcacaaccggttcaatttgcgcaggatcgccaatcgcgactagatgttttgcacgccacgcgataccaaccgcagaagccggcgtcgcttgaccagactcatcaatataaacattatcgatagtgttctcaccaaaattggcaaacatccgtccaacactggccaacgtcgtactcataaccggaatcaacagttgcataatttgaaaaccagcagttagggccaaagtatcttcagcaaagactagcttatcctgatgcgcgaaaaactcccaagcgttcgagattgaaacacgtgcctcacaaataaataccttccgtagccgcattgcagcaatgaataatcttgcacgcttgttctggagaaccctactattgttcggcaaagcctgttggcgtttctcattcgtctgtctccagaagtcatcattaaaaacaacgattccctctttttttcaattgtttttggattggttcaacttcacgaatgattttttctgctgtgcaattaaatgaacaacatgccggcgttcttttcgccgatctgctactcgttcattgagtccttcaatttttttattcaaattagaaatatgaaatcttagactatcatgtgttggcgtttcgtgttgccagaaaatcaaaaatctttttttcggtaatgttactaatctatgccttgtattctcaatttttgtgtcaagttagcgatttcttgatttagtacctcaatcccctcgtctacaactttcaactcaaggtaagcctgatcaactacggatggattggcccgctcaacgattgaaatcattcgatgtaatcgcgctttttcctgatgaactgcctccaatgccgtattaaaattctgtcgtgcatccgcccaactatccgagtatatacacttaactgtttctttaatacgccatgattaatatgtttaaataccttttgctgattggccttactccccatcggaaccgcaaacattccccaagagtccgctgtctccaaaatgcgattcgctaaatcgctaaagtagtcaatttcttctagctgagtccgatactcatcttgtttctcacgattctcgttaggatactgtctgattttgttacgactcggaaattcctttgaaatattggcaaccgcagaattattattgctcgtcaccacaataccgtacccttgtagggcgggaatcaattcataggcattatacttacagttagaaaacaactcaatgggtttaattctccgaaagccatccattggcttttccaattgtgccattactttagcttgttgtacgatcgtatcggcaaacacgtcttgtaatagcgttgttttccggtccccggtggtccattcactgtttttagatcagtcttaatttggtcccttgtcacgaatcacattgactgccaccgctgcatcaatgactgaaagtacttttcaggtccaggccaccgcccatctggtagattttctacatccaataattttgaaataaaatctcgattctgatccacttcttgctttgtcgcaatatcaggatttaaacctaaatacttcaatagtaatgaatcgtccgcagacgcccgcaatacacgctcaatatcctcagtatagaaactatttaacatcgggggttcatcttggatttgaaagagtccccgcaactgaccgacgttacgtgtaccgctaacttaaaagtcttcagtacaatctggttagccagtgccaaacactcagctaagtcggctcgttttcgatcaataacttcttctagttgttgcgacaattggctcttgaagtcatcatattgttgaccatgcatcgcttcctcgatattttcttgccgaagcttcaaataaaaataagctgcataaggtaggtacctcaatcttttgaaaggaccagtcgctattaacgattaatgccacactatagcccttagcaggatcacgattttgaaccatttccgtatctctaaaacgaatattttgaatgctatctcgtaaatcttgtttttatatgcacctaagtacaaaagtgaaatcgtcacatgttgatcacttgattgattattttgagatattttttcatttattgtacctgattcacgcttctgatacgctgtttttcgtatgtctccactaaaccatttagccttcttgtcaagctcaccaccactaatttttttcagctaaatcccaagctcttaaaatctgattagcttgcttattcttcaccctaaaatcctccataaattcataacgatacgcctaccgctttcttcgccaaatcactaggaacaataataatccccagaaaaccagaccttccagcttctcccgatggcttgttttggcaatgcttacagtaatatgcttggtttgaaataatttcacccgttgctcccccttctctaaatttaattacattcattgtacagttctttcacttatcctgacaacctaagctaacaatcaacctaccaatttttagttagtcattcaacaaaaaacagaacgctagattattgcacctccaaattagttgtcattcaatgttaagaaaatacaaacacttagcaacctttacgtttaaccacgaattcgctctaacaaactgaatgcattataattaaaaagcaattaatttatatcgataaatcatgtttttatattaaatagtttatttaaataagttatttcttaaattttttatttaaaaatataaattttacgtttaaatattatacaatacgttcattgggagactataacatgccagcaaaaacacaaaacaacttcattcgaagactaattaaccttcgtgacagtcggaattggtcaaaaactgaggtggccaggaaattagggttgagcagtatgcagcgatatgccaactatgaatatggcacgaatgagccagatttgaacatgcttaaacagattgcagatctatatgatgtgacaaccgactacccgctgggtgaagatagcgcatctaaatggattgctagaaaagataccactgacttaaaagactttctcacagctcatgtggattcgatgacatacggaggcgaagcacttacggaagaagaacgccaacaagtacgagtagcaatggccgtcatcttctgggaatagggctaaacgcgactaacgccccttatgatgaagtatcttaatgttcgaaccaagttactacggacacgcttatggaaagcttatttatcggctagaatattggtcacctttgtttatttatacgaaaaataagcctatcaatacggggattaatggtttgggtaggcttcaacaacttatgtccaataaactgatcgacacgaaaagctgttaataaagggaggaacttcaacatgaagtcaaaaatttagcacttactaacgggattgtagggctagtcggcggcattattttattattcggggctggtttattgctggtggcattgttagcgatgctgccactggatcagtatctaatacatcaggtgcggccgctttcctaaacattttgaaaattgctattttagcattaggaattattgcattaatttattataaaggtgataagcgtgtcggtactgcatcaggcgttttactaattgtcggcggcgcaatcgcgcttattccattcttgggttggattggcggaattctcgcaattattggtggatctttatatttagcttcattaaagcattttagtcaaccacaagcatagtctaatttacaatcagttagtaatatcagccctaaaagaacgcatgtgttaacgatagaaatcgactagttaaaccagtacacactgatattgatacttgtccgactgccctaacatatgctctcgtaaacggaagtatcttttatctttgatagctttcaatacgattttttattttgtaccatatgctattcaaaataaaaaaaaaagtggtaccatttcggtaccactttttagtgattttctttaaatttatcaactttgcaatccttacgaatctcgttctaatgggatagaagtcgtttaattttaataaattctattcccattcaattgtcgaaggtggcttactcgtaacatcgtacacgatgcggttaacgtgatcgacttcattgacgatccgcactgagatcttttgtaagacatcccatggaatacgtgcaaagtcggcggtcataccgtcgattgatgttacggcccgaataccaacggtgtaatcgtaggtccggccgtcacccatgacaccgactgacttgatgcctggtaatacggtgaagtattgccagatttcacggtctaagccggctttcttgatttcatcacgtaagataaagtcactatcgcgcacaatttctaaacttatcttccgtaatctcaccaataacccgaattccgagaccagggcctgggaatggttgacgccaaacaagatcagacggcatccctagcttttcaccgagttcccgtgcttcgtccttaaataacgtccgtagcggttcaatcaacttgaactgcatgtcttctggcaaaccaccaacattatgatgtgacttgattgtttgggccgttgaagtcccactttcaatcacatcggtgtagagggtcccctgtgcgaggaattccatcccgtttaacttcgtggcttcttcatcaaacacttggataaattcgttaccaataatcttacgtttccgttcaggatcactgacaccagccaacttgcttaagaagcggtccttagcatcaactttgatgatgttcaagccgaacttaccttctaggctcgccataacttgatcagcttcacccttccgtagcaaaccatggtcaacgaaaatactggttaattgcgtgccaatggccttgtgcaataacacaccgacgacactggaatcaaccccaccggaaagtcccagtaagacctttttgtcgccaacttcagcgcggatcttttcaatctgcatatcaatgaaatcatccattgaccagttagcttcagcttggcaaacgtcaaatgcaaagtgccgtagaatatcattaccgtagtccgtattccgaacttcagcatggaattgaatcccatataacttccggtcaacatcttgaattgccgcaatcgggcaattcttagaagtggccaccacgtcaaaaccatcaggtgcttgagtaaccaagtcaccatgactcatccacactgactgttcagctggcgtgtccttaaatagggtcgccgagtcactcgtcacgtcaatgttcgccttgccgtattcacggttatcagctgattcgaccttcccgcccgcaagcgtgtaggtcatcagttgcatgccgtaacaaatccccaagattggtaagccccaacttgaaaatctccgggtcaacccgaaaggcgccatcatcgtaaacactgttggggccaccagaaaagataatacctttcgggtgacgggccttgatttcttcagcggtgatcgtgttcggaagtagttccgaataaacgccgaaatcacgaatgcgccgggtaatcaattgattatactgactaccgaaatccaataccaaaatggaatcgaaagacgcggtatccgtttttgccaagttgttcactcctttggattaattaatgctcaataggtctatcatactgatttctaaacgttcggtcaaccagtatgagaaatttcttaggtgctaatatttgcggaaatacacggcatcaatcacatgatgcgcaactttgtgcaaaattaaatccgcacgattacgggttggcaagatataatcattcaagtttttcaagttaacctcttcccaaacacgctcggccatcgccatcgcgtccttcggatcaccgatcgccccccaaggatagaaataattcgtcggatcctggaaagccgttttcatcagggccttgaagcgttctaagtaccaatcttcaattaaatcggcatccgcatccacatacactgagaagtccgtaaaatcactaatgtagatcgcctgattgcttggcaattgcaacacgttgattccttcaataatcaaaatatcaggatgcgtgatcacgtcaaaacggtttggcacaatatcataagtctgatgagagtacaccggggccttcgctaacggctttccgctcttcacatcgttcaagaattggatcagccgcgtcatatcatagctttccggaaaccctttgcgttccatcaattgcatctttttgagctcggcattcgggtataagaaaccatccgtcgtaatcaattgcgtccgccggtctggatataaatatttaaatagaatctctaataaccttgctgtggtggtcttgccaactgccacacttccagacactacccaataataaagggtgattggcggttctgacggtgtaaaaaaacggactccgtttcccgccatgacaagtagtgttcatacttggcgcaacaaatgcgcaaacggcatataaatatcacggacatcgtcgagactaatccggtcattaaacgcctcaatttcgtgcaaattggctgcggtcaatggtacttgatgctgattgttacgataaaattgcttccactgttcacgtgagaagcgataatagttcatctgatcttccatgatttctgtctgccaccattactaaattaatgggttgattataacatgaaacccttatcaaacgctgattaaaattcaaattaaccggattcctaattggtagccaataaccattaatagctcgatactagttaacgctgacctagtaccgagctatgctactgtatcttattcgattttcagttgtgccgcgacctcacgagcctgaccaaacaacgtcgtaataatttcctgttgactggccgaattgtcgtcatcatccccgccacttcaccggccataggcgtaccatgttccatatcgccatcttcaacggctttcgcaaatgaaccgtccgctaacgcgtgtaattccgctaccggcgcgttagtttgctccaatcgcaagtattgtgccaacatcgggttaactagcgcccgtaccggatcgcgctggctgcggccagtcacgattgtatccgtgtcactggcagccaatacccgttgcttataactagctggaactgggcactcctcagctgtcagaaagatcgtaccgcactgcacaccctgggcgcccagcgcaaacatcgccgcaatcgagcggccatcaccgacaccgccagcaccaatcaccggaatatcaacagcgtccacgacttgaggtaataatgccatcgttgacgtttgaccgatatgtccgcctgattcttgaccttcagcaaccaccgcatccgcaccggccgccaccatcttatgggcatggtgaaccgaagcaatcactggaatcactttaataccggccgcgtgtagcggcggaatatatgaagtcgggttacccgcaccagtcgtcacgaccttgaccccctcatcaatgatgacttgggccagttctggacagttcttcatctgtaacattaaattgacaccaaacggcttatccgtcagcttgcgggtcgcttggatctctgctcgcaactgttcggcagataaccccgctgaacctaaaacaccgagtcccccagcttccgaaaccgccccgactaattcatgggtcgcaattcgcatcatggcaccagaaaaatgggatattgaatacctaacatttcagtgattgacatcgtcgtttcctcctcaggtcactaacaaccgttctaactagttgttagtattttcacgatattatgtgcctagtcagtattaaggtcattgtctctcaccgactactgcacttgatgagttaattttaacgtcttattccatcgttatgatagcgttttcttagttattccgacacaagtccccaactgttccactactgatcatcctgacgcaccttaagatttccttcacaagtaaaactaaaaaagtaccactccaggtgaatggagcggtactcactgtcttaaactgacttaaacttttgcttcatttaatgtatacaaggcgtggttcacccgcgctagtaacggtgacaagctacccaccgcgactagcgttagctcgtgcatggcccgtgaacagattgtatataatagttgccgttcatcttcacgttggtaattttcctgattagcgttccacacgatgaccgcgtcaaactccaacccttttgctaagaaagacgggactacaatgacaccaggagccaagcgttgattttcagtttgaatcaacgtgacccgctcaccacgagctttcagggccttcgtgagcgcctcgcattctgctaaggatttcccgataattgccgtcgtatcacgttcagaatcgttcatcgctagctgatcaacgacttgatcaaccctcgcttcaaagttaggcgtcacaacgacatttggcgggtcgccctgacgatcaaaagccgtgacggcttcaccattgactaaaatttccttggtgaaatcagtaatctgttgcgttgaccggtacgatttagtcaattgcacgacccgcgtcttttcagggtcaaataatgtggccaattcattgatcagcgaatggctgttttccttggtaaaaatcgcctggttcaagtcaccgagcattgtgaagcgggcttgagggaagctaaacttcaggaacgctagctgaaaggcgttgtaatcttgaatctcatccaagaagacaaaccggatgtcacgctgcccgtgctttccggtcattaagtcatgcggtacatgtaagctgagaccgttgttaacgagatatgacgttccttaatctcggctagtttccgttcaaccgtagcatcccagtcagcagctgagataccgtgatcagccaacttgatgatcttcggtacttcgcgtaagaaatgcgcgtactgcatgttgatgctcaagaaacggttacgcacgatttgcgtccgggcttttcctaagcgttgcatcacaattttacgtgctaagaatttaaactctttatcgccattcttaaattcccgcggctgattgccatataattgattgatctcttcgcgtgataagtcttgaaccgcttcttcgacccacttggaacgcatctccgattcaaccttgcgattcaaaatcttgattaattcttccttagttgctgataaccggttcgctaagtggtagttttcgttgaaagagtagtaaatcgatttaatcttttcccgggaaataatcacttcatcgttcaacgtaatgttacggaaacgcatgtccgcttgttccaaatgtcggccatacgtggtaaccgcgttgaagaatgcaaggctaccttccaacttcgtaacctttgccatctgcggtgtactttcagtttcaaaccgctgctgtaaagtttcaacttgcatgtgtggtaaccggtacgatgcgtattggaaataagtcatctgaaccatgttttgttcacccagttcgggcaatacttggttaatataatcattaaagagttgatttggtgagaacaagatgacttgtccggccgtcaaattaccccggtaacgatacaacaagtatgcgacccgttgtaaaacggacgaggtcttccggaaccggccgcccccgcacaaacaggaggtcagaactcgtatcccgaataatggtattttgttccttttgaatcgtcgtcacgatactcttcatcttcacatcggacttttcatccaacacttctagtagcatcgagtcaccaacggcttcatcagtatcgtagactgtcacgatctggccattctcaaccatcaactgccgcttcaacttcacattaacggtctgtttcaccatccggagtctggtacgtcacgtgccctaacccaccgtcataataaatactggaaataggcgctcgccagtcgtagatcaaaaagtgatctggcgtgtcagaaaatgaactgagtccgatataaatcgtctcaggcttaggctcgccagtctcatgaaaatcgatccgcgcaaaataagcattcttttccaactttttaacgtcgataattgcttagtcgcgtgcttccaactattctgccgctcatccatcatctgttgttgctgccgcacggataatccggtctccatcatgccttcgtaactatccgttttaatattgatattattcagcaagtcacgtttaatatcggcctgatctttttccgagcgcgtaatggtttggctttgttgctcttcagccaccttaattttcgcaaccacatgatctaagtgttcctgttctgcagctttaattgacttagccattgaacgccctccattcctaaatatcgagaaacaataattttatcactatcggcgccccgactcaattaataacccatggcagccgccagtttttgatttttatgtaaatttgtttgaacattggtctatcaaagttacgattgtgttaaactgaaaagaatgtaatcggttacatccgtttttcaacccgcagacgcttataataaatgcaacttaaattggaggtggcgccgttggtcaatttaataaccattttaacccatttagaacaaaatatcgtcccactattaaccacgcttggtagttggtcttacatcttattattcgccgttatctttcttgaaacgggcatggtcgttttcccatttcttcccggcgaatcattgatctttctcgccagcacgatggctgcaactcacagcgacgccctcaatattcagattctggtgccagtattctttgtggctgctgtaattggcgacactgtcaatttcgaaattggccgccatctgattcgcttaccgtggttggcagcaacgccacctccccaatccaagcaacaacgcgcacaacaattttttgctaagtatagcgcgaaagctgtcatgtttggccgctttgttccactcgtgcggacctttgtcccgctgagtgccggggccgctaaaatgccacaaacgaccttcgctatctggaacttagttggcgttggtatctgggtcagtgtcggctgttcactcggttacttctttggctcgatcagcttcgtacaaaaccacctctcgctctgttttctaggaattatggccgccgcgctcattccagccacagtggttgcgctgattaagacctggcgacaacggacaacactcaatctcaaataagcgccacacacaacacggttgatctgcaatcgtgtttttttattgcttctcgctttgaaaggcacgtctttccttttcaaaaccactcaaaaagtgtatcctttcaatgacttattcgagtggagggattctatgcagccaattcaattaactgcctatcaatctgactggcaaaagcaagcaatcgagtatcaaaccttgttacgccagcaattacaggcgaatctattaaaaagtagtcacgtgggtagtacggccatgccccaattattagcgcgtccaacaattgacttggcgttgcttgttaaagatcaggcggctgccgtagctacgttacacgcacgaccggtcgctggaacaacgcatacttacgcaacgcaattagctgctaacaacatccacgtgatcattacaactgatgaacagcattatcagcaattgctcactttccgggattatctcaatgcgcaccggacagacggccgcaagtatactgccattcgcaaaaaggtgtgcgcaatgggcaagccgatctcgcagcctacctacaaacgaaagcagcattcatggcaagcatcaatgacaaggcccaagactggttagccactaaggatcagcatgaacaccacgaccggaccgtccgtgcagcagaactcgtcaacatgtgcctcattaccaatccagcgaccggcgatgtcctggttgaaaataagattgacgcacagtggtcggggttaacttttcctggcggccatgttgatcgcggtgaatcacaagtaaccgcgatgaagcgtgaagtattagaagaaaccggcttgcacgtcgatcaattgaaattagttggcaccgtaacgtgggtcgaaaatgcggacggcgacgtgtcgcttggtaccttatacaccactagtcactatcatggtgatttgctagccggctcatacgagggtgccattagttggcaaccattgagccaactgacgcctgacaaattagcccctggtgtcgaccaaatcctgaaagttttcaccgatgcacatgctagcgaagctttctggggctttgatgatgatcagctccgtgtgtactaaaacgaatcgaggtatttattcatggatcaagtttccttagtcattattttattagccgcattattaattccgcttatcatggctaaattcaaaatcaacagtttgccaacggccgtcatggaaatcattgtcggtatcgtaattggccccagcgtatttaactttgtgaacacctctgaccttatctcacaactctcaacgattggcgtcatcgtcccgctgttcttaagtggacttgaaattgactttagcctatttaagaagcggcgcacggcgttaacacctttagaacaaaaaaacgcggtcaacacaccgaaatattcgccagttcgactttcggtgtacgcctacagcacaattattgttctatcgctgttactcgccgctgcttttaaagtcagcggcctcttcagtgatttctggcttgccgcgattttatttggcacgatttcacttggtattgtaattgcagctttaaaagaacaggaattgcttagtaaggctttcggacaaacgattctgctcatctcggtctttggtgaacttgtaccgatgatgggactgacgctctatgcatccgtctacggcagtaactcacaaagtctctggttactattactcattttagccgttgccgcactattactcttacggttcaaaccattcttccgcttctatcaaaatattaacaaatcgacgacacaactagatattcggctagccttcttcttgattgtaacgatggtcacggtggccgaatccgtcggcgctgaaaacatcctgggcgcttttgtggccggaatcgtcttgaaactcttgaatcctagtgaaacgacccgtgagcgcttggatgctattggttacggcttcttcatcccgattttcttcattacgactggcgttgatttgaacttacggaccttattaacaagtggcaaaaccttactattaattccactatttttcttagcatacatggttgccaagattggcggctactgggtcctaaagttacggttcaagcaagccaacgctttagccggtaccgcgctgactgcagaaacgacaatgacaatggtattagccgtccttcgagttgccaagtcaatgaagacaattactagtgaccagtccggtgctttttactcgcagcgctactcacttgtgtcatctcacccctgatttttaacaagttttattcagctgaaaaagaagacctggtcaaaacagcggtccactttatcggcgctaacttaagcaccgtacccgttgcacaacagctacgaaaaggctggtacgacgtgtcaatgtacacgaatcatcctgagaattatcagacctaccacgcgcaagtgccagtgaccttaatggaaaacttcacagcccaggacttacaggatcacggcgtctttgacacggatattttggtactcggccatattgatgccgagcgtaactacgagcttgctaaagccgccaaagcatacggtgtacggcggatcatcgttcggtttgaagaccgcaatgtgctcaacgaacatgaagatgaactccgagaacttaggcgtcgaagtctacaatacaccagaggccaacattactttactgcgcgccttaattgaatcaccgtcaaccttgctattgctcaatgatactgaaaacagcatctacgaagtccgggtcctcaaccatctctatactgatgttcaaattaagaacttacagtttgctcaggatattaccattagtcaagtcatccgtaatcggaaactgatcgcgcccaatgggaatacgacgattatgtacggtgaccgcttaatctttaccgggaataagcagacggccgctcagattcgacaagccttagcaactgctaattaatcgcagtgcattttatggtaaactaaacacattatggcttagttttgaacaccaagtagaggagtaaataatggcaactttttccgtttacatgattcgtcatggtcaaacttactttaataagtaccgccgaatgcggggctggtgtgattccccctcacagctgtcggcgaacaggacgtcgctcgcaatgcgggtaaaatgctcaacggtattgatttcgatgccgtttacgccagcgacatgacgcgggcaatgcgcaccgcagaattaattcttctcgccagtggcaataccgatttgacggttcaaccaatggccgccttccgtgaagccttttatggctattttgaaggtgatgatacgtcgcagacctggttcatggttggtgcgccccatcaagcacctagcttgtccgcaattattgaacaatacggcatcgaaaaagccaaagatttctgtaaagaagctgacccgttccatcgcgccgaaaataacaccgaattctggcaacgggtcaatggcggtctcgatacgttacgtgctcaccatcacgacggggacaaaattttggtcgtcagccacggcaatacgatttacagtattgctgctcgttttgccgcactgacctcaccagcacggccccaaaatgggagcgtcacgaaattcacaattagcgacaacgatgtgacgttagactactttggccgcaaagaccatctcgactaaataaggagaaacacatggctcaattttcaatttactttgttcgacacggacagactttttcaacttatataatcgcatgcaaggctggtctgactcgccgttaaccgaatacggacaagccaccgcaaccaaggtcggtcaagcactagcgaacacgacttttgactactactacagtagtgattctaagcgggcaatcgacaccgctcagctcattcgacaagcggcgggtgctaccgcccagccctttaaaacactgatgaactttcgggaagttttctatggttatttcgaaggtgacgattcaagtcggacttggtcactagttggccgccaatacggggtcaccagcatgcacgaacttcttgaacacgtgcctatcgatcagactcgcgacctgatgcgtgaaatcgacccttggcatgaagctgaagacaactcgatgtactgggagaacggatcaaccagggctttgactacttgaaagctcaccacgatcaccatcaaaaagtcctcgtggttacccacggcacgacaatccgcagtatggtcgcacattttgctcctgaaatcgacatcacgaacggccccaaaaacgggagcgtcactcgcatcgacatcgatggcgatcaaattcgcgtcgtcgattatgcgcaagacttagctgacgtgaaagtcaatcaacacttataattttgctcatcaaacaaaacgctcgcaaccactaactggtcgcgagcgtttttatattggctctgaaataactgttgttggtaattaactaaatacgtgattaccggcgacagagatttttatttgtattttaatcatgggctattgaatcgttcgaattaaaaaaggtgcttgccgttgctcggctaagcacccatagaacgattcgcaacatcattgacggagaaccaactcggctgtcttatcaatgatgtccttaaagtctttgctttgctggttaaggacgtgtttgaagaattcaggtattgctaccccaattcaacctattttttcaaaaaagccagcacgttcttcttagacggtttcatgcttcccgctaagaacgcaattacgactgccacaacagcaaacaaaagttcccagactgaccaattaaaaactaccgttaaagctaacataatagcagctgcaattatcaagacgccatctctggggcctaaattcagatacggatacatcatcatcagacgtcacttctttcactatttgttgtacttaaccaagactatacacggaattactgacgaaattaagaagcccctccgagaggtagtgcgttgaccgggtgtaacaggaaaattgtgtaaagtcttggcaacagtgcgtctatctcaggtcggaagaagtctaagaataatccacatattcatttaacttctatgattattataacaccgctttcacgcttataatcattcttttataaagaatattgagaagctgttggcggcttcgctaacgaatcacaaacccactaacacccccaatcctaactcgtgactttgataccaataatgccaatgaccagcattgcaatgaagatccacgtgatgggtgcaattgtatctttgaagaaaaccaggccaacaattatcgcaccgaccgcaccgataccggtccaaattggatatgcaatactcaacggtaagtgtttggttgctaatgctaagaagccaaaactcaagaccatgccaactactgtggccgcagcatagccaaagtgactgaacccattacttaatttcatcatcgtagcccataccacttcaaataatccagcaataattaaataaatccacgtcattatcaattcctcctcaaaataaaaggacaacgtccacccaacttccacaatgacctaaggaagttgggttaacgttgtccggtgacaattcatcttaatatttcagtccactatagcaaaccatcatctgcatggtcaagcttactcaccgcaaagcatccactttgtcagtggggtcaacggtgtcggcaaagcatctaaagcaaagaaagccgcagtactcgtctcatcggtggcttgaatcaattcaccacccgttgtattggcgcgatataacgtggtgacactgtcaataatgtccccgttaggatattgatagtgcatcttgggcccactatagacatcgatcagcgttaactcacccaccgtcagcccagtctcttctttcaattcccgtcgcgccgtttgctggaccgtctctcccggttcagtcgatccagctggcaagccccaacagtggttatcggttcgataaatcaagacaattttgccaatcgaattttgggccattaaagccgcactgccactactagcggttggtgaccaactcgccgccgcaaatcaagcacgtaacccatttttgattcctccctaatacccgaagtcgtaatattttgattagaggcatgttatacttaatgcaatcataacacgttaggagtgagtgtatgtctgaaaccaacgctcaaaaagtacaagaagtcatcattgccggcatgtctaaaacggtcgccaattacgactacgccatgtccgagctagaagcgctcgttgcagccaataatatgcacgcggccccgcgaattgaccaaggcttggaaaagcccaacccggccaccttcttcggcaagggtaaagttgtcgaaatcaaagaagtcgcagccgccaacgatttgcacattatggtcatcaacgcggatctgacccctagtcaggtgcgtaacttagaggaacaaacggacattcagatcatcgaccgtactggtctgatcttagaaatttttggtaaccgtgcgcggagcaaggaagccaaattgcaagttaagattgcccaattacaataccaacttccccgattacgaacgagtatctccaatcgccttgaccaacaagccggggccgctgcctggtggtggcgggggctttaccaaccgtggtgctggtgaaacgcaactggaattaaatcgccggacgattcaagaccggatcagtcacgcgaagcacgaacttaaggaactcaataaagacgaagtagtgcgacgctcacaacgcgataaagccgggctccccaacgtcgcgttagtcggttataccaacgctggtaaatcaacgactatgaatggtttagtgaaactgttcggtaagggtgaagataagcaagtcttcgaaaaagacatgcttttcgcaacgttagatacaagtattcgtcagttaaccttccctgacaataagcagttactgctcagtgatacagtcgggtttgtcagcgatttgccgcataacttgatcaacgccttccgttcaacgctagccgaagctgccaatgctgacttactcattcaagtcatcgactacgccgatccccattacaaggaaatgatggcgaccactgaaaagacgctcaaagagaaatcggtgtgcacgatgttcctatgatttatgccttcaataaagctgatttaaccgaagccgactacccgaaccagcaagatgatcaactcatctatacggcgcgtgatgaggcctcactacaagctttgaccagtatgatcaaagccaaagtctttaagaattacgtgacaacaacgttattaatcccgttcaatgatggtgaagtagtggcttacttgaatgaccacgccaacattctcaaaacggattacttagctgatggcacccaattaacagtcgaactcaacactgtcgatgcccaacgttatgaaaaatacgtggtgacacccgcttaaacgactcattcaaaaagatggctctaggattaaccgcctagaaccatcttttttgatttaacaatcaacccactctgttaatcgccaaaccactagtgccaatagtgaacatcattcagtcaccattaacgcgtgcaattgcgccaatagttcggactgcattgaccgtcctcgccattgacgttgaaaagcataactagtccccttcagcatggcaattaacatatcagcttgaaactcacatgccggtttcgaaagcgttggcttcaaatcacgaaccagttgcgttaataggtcacataattgttgataaagttcgctctgataaaattgacggcgaccaggttcaccggcctcgacattcattaataacgccatgttgtgctcacgaatcgctaaatattccccaataacatgatcaaaacgtgccgctgcacctaccgaggtcgtggtcaagtagacttgattggttttaataaaagttgcgactcgatccgttaccaatgccaaacatagtgtacttttatgggcatagtgacgatacaacgttccgggaccgataccagcggccgtcgcaatatctttcatactaacggtttcgattgaacgcgcggcaaagagttgtcgcgcagcagtcaaaattttctgttggttaatttgtgacatcctttcgcattcgacacaccctcctatttacttaagttcaccatacacttttacgcatcacttgacaaacggagtgtactccgtttaaggtataattatacaatctaaggggaattcactacgtttgtctttttatccggattactaatcggcatcttcgttagtctgattggtggcggaggtgctgccctatacctaggtgtcttaaccagtcaagtaggccttgcaaccgcggtagccgtaccaacctccctaatcgtcgccttaccagccttattctttggttttctaacacagttgaaaatcaaaaatgtcaatttcaagattggcaatcaaatgatcattgcggccgttcccggtatcatcgtcgggacattcagcgcacaatttattccccaacaactgtataactggattgtcgggacaatttttttgattatgggtgcgatggtactaatcaagtatgttcaccattctaaacaaactacagccggtcaaccaaccttggcaagctgccttctttggccttttaagtggattgatggtcggcattggcggcttaagcggtggtgcgaccacggctgccgggttagcaattcttgggttaacggccgttgaagccgctggtactgccacctatgtgttaactgttatgtccacaatcagtttaatcggtcatctctttactagtacttttgcttggcaatcaggattggtcctcatgattggcgcaattatcggcgcaatcattacaccactcgtgattcgccatttaaatttagataaggtcaaccgcgtattaacgccatttcttggtcttattattatttattttggcatcaaaatgtttatataaaggcagataaaaagtcacttcagacagtcgtaaacttgaagtgactttttgatatcccctactgaaaaattcataatcatgtgtataccaagaacaaccttctccagcatgttggtggctaagctaactgccgacgactgaactaggtaaacaacgataatcaatggcaacgtcaccatcatcacgggataaaaccacgccattggtaattgactgctaatcagcccgccaatgatggggccaagtgacatcccgagatcaacaccaatataaaacgtactattggctagcccatgatcagctttcggcacgagcatcaatgctttagcttggcaaattgaaaacatcaaaccgtatccggcagccagtctgctgcacccagcagtagcatcgcccaattgttcatgtcagttaagccaatcaatcctaatagattaaaaattaagcataaccagatgaaccgtttaaatggcacccggtcgaaccaatcgcggagaataattctcaatactaataaaatacccgcgtacaccgggaaaaatacccccgctgccacatgaaaatgccgtgcagcgacgtagctgacaatataggtttgggtggcaaaatatggtaatgaaaataaaagcaaaatcaaggtccccacggggattactcgtggttgtacgatgcgaatatggtgcttagtcgtagccgtttgaggcgtcacaattggttcaccatgatcaccgacgaattgaatcatgatgatgagcagtaaactacagcccgctgctaaccaaaaaacactctggtaactgtaatgttgatacaagaagacactgattgccggcccgcacgccattccaagcgcattcgctagcccataaatgcccattccagagccaattcgatcgggtggcaataaactagccatccaggttgccatgcaaactgaacacaaggtatatcccaacccattcaaaattcgcaataacatgattaacgtcacgttggttgtcaaactataacctaaactagctagtagcaacaaacagcccccacgaaggtcaaacggtacttagagacccggtcggttaaattcccagcaagtggccggagcactagcgatgtcaaattcgttaacccggcaatcgtacccggcaagcacactactagcgccaataccgtgcgcaaatcccgcaatcacgggattgattaacattggactcattaaaaagaagaaactagccattaacactaactttacatccggcgtatataaacgcgtcttcatcaattctcatcactttctaaattctgattaacttgccgtaacaaatctaaaaatacctgttgttgttcggcatccaaatgggcaaacatttgcgcactcgtctgccagccatgttgacggagctgctcgcgtttagcacgcccactcggggtcactaccacttgcttggcacgcgcatccgttggactgaccactaattggacatatccgcgcgtctgcaagcgttgcacgatcatcctggccgtctgatgggtgatttcctggtacgtcttaaacgcggttaccgtgcgacctggctgatccgtaaaaaggtcagtgcatccgcttgctcagtcgttaaccccaccgtccgcaaatgttggtttgcgacgccgcttgatttgacgagctaaaatcagaacttgccgcgccaccatttcatcatgattcatcttaatcacacgccctttcatttatacagccagctgtataaattgtcaaccagcgaccgctatttttctagcagcctgaagatcattttaaacaacgacaaaaagtggctaggcttggttagcctaaccactcataccgttgactataacacatttttccggcgttgcgcggcacgccataacgaaaaggccgtccaacagctcactaagacgatcaaccaactcagggctgttaaggacagtgacttaactaaggtcgctgccaccaccacgccaataataccgcctaaaataatgccgaataagccgcgataatcgacgcggtcatggcgaataaaattcactgccgaaatcggcatcaacaatgcgcacgacagcatcataattgggaaggcggcaatcggggtcaatcccagaaaatacaccattaccaaaaacttttacacggtgcgtacagtccgactccggctgacatcagtaaccctaggataaagttgccaccaatgccgaccaataatttccaaccggatagccccgtcgcctgattagcaactcccagcaaactgatccaacctaataacttcgctgccatcagtaaagcagtgatgactaacgcaccggccatgattaactgaatccaccgctgattaagcttcgtcatgacttcactacccagtaatgcgccgagcgttgctgctaaaactaaactaatcagtgtcactggctcgaccgcaactgctgtaacaaagaaaaacgcctcaaacgcggtcggaatcgcatgcatcgtgttcaaagttccaggtagcttacgttcatcctttaaataatggctcgcttgaaaaattgccgtggacacgacgaaacttccgataccaagtgtgtcaagaaaatccgtcacggccccgataaccatgccgaaaccaaaactgtggtcaaaaaatggcgctgcttgccgtctggcaccggctaacagcaacccaaataagccgatgctgagcagcatcaacaacaccacaattgcaattaccatcaatctaaccccactctcttacctactcgtagcattatactgtatttttaggaaggaaccaaaaattattaccatgacgtcactgcaagtggtacccacaatcatcagtttgcatactgaacgtgaccaccagaccataagatcccaccggcactagggcaactaggcccacagattgtcagaatgtgctataatccaatcaatcgattgtgcacaatcattattagaacgtctccgcacttaatactcatcgcatgaaaggcggtaattatcatgaagacaaccacaattcgcccccttgaagaccacgtctgtttttcaacctacacaacagtccatgccattcaacgcctctaccaaccaactttgacagcacaccgactcacttatccacaatacttggttctagtgccgcactctatgcgacaccgccgcgcgctgtcacggtcaaaacgttgagcacccagctaaatttaagtacgggaacgctgacgcccgtgctacagcgaatgacccaagctggtttaattacacgccatcggaatccccaagatgaacggagcatcttgctcactctgacacctcaaggaaccgcaacacgacttgctttaaatgatttgccggatttattgactgctaagggtggtctcaatcaatccgagtgggcacaactaactcaattaatgactaagttaatgactaacctgacccgttaaataaccccgctaatattatgaagataaataaattaatttaaagccaccacgccgcccaatcctattttgtcgaaactcgaatcaccaaccgaataacactgatcatttcgaatcttgtcgaactttattattaaaatatcgttattagttcggattttgggtgaaaaaccggccacaaccaacgatatttgattgtcatcaccattaatctctggtatgctaagtgcaatcatttagaatttggttgtttcaagggaggatttcaggttaatgcaggaaacaaagcaagcaacgaccctgaaccgttcactcggtttttggtcagcactttcactcgtcgttggtacggttattgggtcaggaatcttcttcaagcaatcatcagtccttgatagtgcgggctcaccgagcgctgcgttactcgcctggttactaggtggactgattacgttgaccgcgggcttaacaatcgccgaggtcggtgcccaaatgccgcatacgggcggactctatgtctacatggaacaaatctatggtaaattgtggggctttctctctggttggatgcaaatcgccgtctacggtcccgctatcatcgcttcaattagcgcttaccttggtatattactagttggtttcttcaacccgcaggcgggttggcgggcgccactctcgattggcgtcatcgtcctgattggaatcctcaacatgttcgaaaaccgttggggcgccgcatttcaaattgcgaccacgttgggcaaattattaccgattgcggctattattatttttggactcttctatggtaatcagaatgcgctgggacagtctttacatacaattacccaatcaacgggtagtttcggggttgccgtcctcgcaacactttttgcctatgatggctggatcttagtcgctaacttgggtggcgaaatcaagaacccgcagaagttattaccacaagccattattttagggatttcaatggtcttgattgcgtataccttagtcagctatgggattctccacttcgtacccgcggcaacgatccacaaactcgggcaacaaacgacgctgtactttgcccaagcggcgtttggcacaattggcgggcgcctactgaacattgggattatcatctcgatggtgggctgtttaaacggcaagattatgaccttccccgcatcgtgtacgcttcatggctgctcagaatcagctgccattcgctaaacaactcagttacttgcacaaaaaatcacacgagccgatcgccgcaaccattgccattctcgtttatgctagtattatgatcctgttcttcaatccagatcgcttatcggacctctatatcttcacggtctactgcttctacgtggcaaccttcgttggtgtctttattttaagaaaacgacgtccagcttctgagcgaccattctcgacacctggatttccgatcacaccgctgattgcgattcttggcgcgctgttcgtgattatcagtgaaattggctcagacttatcgggtgtactgatttccttggttatcgtggccgttgggttcccaatctattattggaagcagcagcaaaatcaaaatgcttaatttaaattcttgataacttgtaaaagagcgttgttactgaagatattttcagtagcaacgctttttatgcttttcaacgcgcattgaaataagagttgatttaatttgcttaccgattaccttaacgcttagtaactaaacctcactatatttgattaatttgatctgctgtcgttctaaacattcccgcatttgaggatctgttaacattgcgacttcttgcgtccggggaactgttaggcttgaatgttgtaataagtagtcatccaaatagccaggatgacaaaccatcatagcatagccgtcattatattgggctagtgccgcacgtttcaacgtttcataagggttatagtttttgcccatactttccataaaaacatgtaatacttttcccttaaatagcacactcggactatctgggctgctgcaaagcgtaaaagatttaagtgatgacgttcacccacaatttccaatcccttaacaaagttatcactaactaccgcatgaccctcaaaataatcaggctggcgaccaactaacgctacaaatttttgatattgcgcttcgatttccaaaacaacttcattaagatccgacaaaatcatgaatagccgcccgataatccgaggaatgacgaaaggtaccatctggattagtgatgctcggaatcaattttggatttgttaatggccggccagcagatataacagtatgcaaccctaagcaaacccccgcatctttaatcatggctaatcctgacatcgtcgttggcatattgaccataacacccacattattaattaacccgttgtgaactgttcgtgcaatcccaacattaactgcatcggaataacctaaatcatcagctcgaacgattacttttctttccattagcttttaagcctccactagtttaaattctttagtcccctgtttgtttgtattggcttcaacaccaatcgcataagttgcaatagcagctgctacaaacgcaatcacgccactaaccacaccgttaatcacattagatgtttgcccgccaacatacgcagttaaagataaaaagtttgcaacaggtaccatgacataagctcgtaactgttgtcaggccagcatataagccaccgcaaaatccaccaatcatcatgccaataaacggtcgtttataacgaattgctagtccatataatcctggttcagtcacacctccgataatactagcgattaaataaccccaagcaagtgtcttttgatcttggtccttaattcgtaaggccgcacccaaacacatgcccgcgaccgacatactagcggcaactgcgccaagtgtgacaaagttttcatgacccgattgcgcaaaaatcatcatcatcgtcgtaagcattaagagatgcatcccggtcataaccaagatttcccataaggcaccaaccactccaaccgcgataatcgttggcaagccacctaattttccaaaagccaatattcctgtacaaatgtaattgccgataaagtttctgctgggcctaaaatacataacgaaatcggcaacatgattgcaatcgtcaacgttgggataacaatcgtactaatcgactctggtacataacgcttaaagaaccgttcaatatacgacattacccaaaccgacaaaataattggaatgaccgtacttgaataattaactaatggcattgcgataccgaagatattaaatgccttgccagcagtcacaattttaattaaattaggatcaatcaaaattgcacctaaaaacattgaaataatccgtgacgtattaaattgcttagcagctgtatatcctaagatgattggaaaaaagtagaatccagcatcaccaaccaacgtaaataactgatacaacgatgttttagtaccaagaacattgaacatgcttggtcctaaaatggccgcaaacattttaaacattgatgcagcaatcaacatcggaatcaatggtgttaaacatccagccaatttatttagaatcatatttcccgcagacttaaacgttaacttttctttaggtcgattatctaaatcttcattaattggcgcgtttctagttaaattccccaccgtaagtaacgcatcataaactttgctaactgcttgtccaataatgatttgatactggccaccagcgcgattgacaccaatcacacctggaatattctgtacctcaccatcattaggaatactttcatccttcaaattaaaacgtaatcgggtcatacaatgtgtcaccgaagaaatattcgcactaccaccaactgcttccagtacaccattcgccactttttcatactgtttatccttatttttcatgtcgcatacacctccattaattaacggttacgcttgagtatttattttattaacgattcttttaacatatatcattagatagaaaagttcatcatcattactattagtatcaagttgactatcaacgtagtctgcaattcgctttgctaccaagtaaatttcaggctcatcatgcctcatcgtattgaataatttagaattatcattttcagaaatttgctcatgtttcttcatccgtttaatgtaataccgtaaatgcatgacaaaccggttgtatgtgaattcggtttgattgattctaagctcatattcttgttcaataatttttgtgatgatttttatcatttcatcgtcgctatttacacttgaattggtcgctaaatcattagtctgagaattgacaaaatgcatggcaattgctgtgacctcggaaactggtaattgaatatttagccgtcgattaattaacctgacggcgtaatacccaacatccgtttcttgtgggtataattgctccacatcatatgaaaatggtaactgggcgcttttataatgggttagtcgcgttattgcaaagttaatatgatcagctaagctaaaaatcatatttggattcaaaattcttggaattagtgccgcgctcgctcaacaattgccgcactcaaatcaaagatttcagtggatatttcttttagtaattgatagtattgatagtttaatttataaaatgtcatcgtcacttttagtcatatcagtaagctcatacgggactttttgaaatcctaatcccttaccaaaggcgaccaattcttcaccatgttgatcaagacaaacgaccacgttgttattaattttcttcaccacccgcattttaattcgcactcctttacatagtttatgcttgctttaaaactggtgtgccggctgctaattgttgatgaagcttactgctaagtggcacttcgcccgtataaccttctgtaaagacaactatggtggtcatatctaatcccgcggtcgccatcgtttggcgatcgagcgtcactaatagggtccccgctttaacttcttgatttaatttgacgtgtgccgtaaagcctctaccatttaagccaactgtatctaggccaatgtgaaccaatacagacacgcccctagtctcatccatgatgccaatagcgtgtttactttcaggtaatgcaacgattttcccactaatcggtgccacaacttgattagtagtgtcctcactcggcctaatagcaaatccatcacccatcattttctttgcaaacacttcatccataacggccgtgatcggtatacaaataccttcaatcggtgtaaccacctcgaagacatcaactttctttcttttaattccaaacatcactgaacctccttcaatacaaaaaaactccttgaggcacccacttcacccgtatatttcaacaagtaaaaggtaatgcctcaaagagtatgagttacaatccttaatttcagttttacagaaaacgttttcattaactatattatcacgccttctattttttgcaagacatttaaatattttttataaaaaggccaaacaaagcattattgcttgtttggtcttttcattaaggaatttcagccatcatcccaccagtttaattacgctaacttcttatccaacacacgtgacagaattgacaaggcgtaacaaataatgaagtacatgactgcgatcattaagaacatcgggtgtaaaatatacgctgagttctgaccataaataatttgcgcatggtttaataattcaggtaaaacaataatggttgccagcgacgtatccttaatcagtgagataaattgactcacaatcgttgggatcgtcttcttgattgcttgtggaaagacaatgtgccataacgcttgtacatagctcatcccgttagcacgggcgccttccatctgaccgtaatcaaccgccaaaatccctgaacgaatgatttcggctaacatggccgattcaaaaatcgtcatagcgaggatggctgcgaaaatgatcccaggcttgaatcccaagtgtggcaagccaaagtaagtaaagaagataattaagatcaatggcaagtttcgaataatgtcaacaacaaacccaaccactgccgataaatatttaatcttgacgtaccgaagcacccctaggactgaaccgataataaaactggcaatgatggaaacgacggacacttccaccgtttacccagagtccttcgagcaagaaccggatatttatccacgaatacgcttgaataaagttttgcatgaatcgtcgcccccttctagtttgctaatttttttctctaagtgccgcatgtaataactcagtggcaacgtaatgattaagtaaaagacccctacgaccacgtagctattgatcgtatcaagcgatagtgacgcaattgaatttgcttggtacatcaagtcgaacccagccacgaaagctaggacagaagagttcttcaccagattaataaactggttgcccaacggtggaatgatgattttaaatgcctgtggtaagacaattttactcattgcccgccagtacgtcatcccattagcacgggcgccttccatttgtccaggatcaacagattgaattccggcccgaaccgtttccgcaatgaatgatgaggtatagattgttagcccaattgtcccggcagtaaaaccatcaatcttggcaacatacattggaatgatcacgtagaagaacatcgcaataactaacaatggaatgttccggaaaatttcaatataaactcgaccaatgatgcgcatcgtacgacttggcaaaacttcaaagatagcaaacattgttccgatgatcgtactgaataccaaagcaatcacactggataacaacgtatatccgagtccttgaatcagctctgaccaatagtgcgttagaatgtatcccattagcgtgacgcctccttatagtcgaagccggccacgttaccaaaccacttcttcaagatgcggttgtacgtcccgtccgcttcaatttctttgagcgctttattcagagcctttttaacggttcctgacccttattaacagcgatcccgtatggttctttcgtgaaggtgcccccaaccacttcgtaccctgggttttgcgacgccatcccgtaaagaatcccgttatcagtagtcaacgcgacccctgaccagatttcaacgcccgtcattgcctgagcatagtcggataattccaacaccttagccttaggcgctgctttcttaatgttctcaacggagtttgcaccggtcacaccaaggaccttggtgcccgacttattcaaatccttaactgattttatggcactgccctttttaaccaacagtgattgccccgcatcaaagtatgaattcgtaaaatcaacctgtttttcacgttccggcgtgatagtcatcgtggcgataatggcatcaatgttcccattcttcaacaatggaatccgcgtttgactcgttacttggacaaacttggcggtagcattcttaccgagcacccgctttgttaatgccgtcgcaatgtcggcgtcaaaccccttgatttgattatctttaacgtccatcaacccaaataatttcgtatcagctttaacaccccacgtaatcgtcttactagctttatcattggtcaaaacatcctgttttgctaatgattgccgtgaaaccgcaagcggttaagaccaccactagcatggcaagcatgccgagtgcgccaattagtcgtttcagcttcttcattcgtggtcctcccctacaaattagtgtgtaataattttactcaagaattgacgggcccgttcattagacggctgaccatcaaagaacttttctttagcatcatcttctaggatttccccatcagccatgaaaataacccgatcggccacttcgcgagcaaagcccatttcgtgggtcacaactaacatggtcatactggagtcttcggcaacactcttcatcacgttcaacacatcatcgatcatttcgggatctagtgctgaggtgggttcatcaaacaagagacacttcggcttcatagctaaagaacgtgcaatcgcgattcgttgtgattgcccaccagataattggctcggtaagctattggccttgtcagccagaccgacactatctaataagtccatcgctaattttttattctcatctttccggccgtttcaagactaaccgggagcaatcatgatattttcaagcaccgtcttgttagcgtacaaattaaagtgttggaacaccatcccaacgtttttgcgaattttattcatatccgttttgcggtcggctaaatcaaacccattgactagcaattgacctgactggacacgttccaaaccgttaacggttcgaatcaaggtactcttacctgagccagatggtccgatcaaaacaactttttcaccttcattaatcgttaaattaatatttttgagggcgtgaaaatcaccataatacttttcgacgtcgtgaaattcgatcattgacattgcagtcaccttcgctttctctatcagcctgttgactgacggtctagaattattgcattaataattagagttaagaaatccttattcttcgttaatgctatttaaatagtttaatacataattagtaattttgtcaaaaagtagctaaatattgttcgatatccataaaatagtgataaacagctacactgttttcagttaaaatagctgaataacagctccaatattgaacattattcgtgaaaagccaataataattcgcttttctttttggaactgccacggccgaataatttttagacaatgatttcaataaaatttatattattctaacaactaaacttaacccgcttttaatcataccactactgaaagccaccgaagcgtccgacgcataattttcacaattagtggttttaactaactgaactttaaaaattgttaacgcttccgcaatcatttctttaataatcactgctaacctagaactattaagaaattaatcatctgcattgtaacgggagacgataatatgttacttgaccaagcagctaacatgactaacattatagcggcccagattatcaaagtcttttatccctttgtgattgtcaagactgagggtagcgtcaagaatcttgtgtaaatgaaatgccttcgtactatataatatgtatctaacttaaataaatgatgcttccaaggtgtcctggagtcctttgaaccctcggtggatccgcctcagagacttctcgttataaacattaaactgagaaaccagaaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttggggaaatgccgattcaagccttcatccaaaaccaactaacccatcggccacaaacaacagcacatctttaacgccccgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggcttttgagtagtgagcaccgtacattttctcaatgagttcggcaatttcagcagtggtaattcccttggtatacaattgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaattccagcgtatgagtagcgttcgtaacccaaaaaccccgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttagacaagatattttacgctctcagactgagacgggggcctacttaaaattgaatttatccaccaatgaacaacgcgatccactcttctgggatgagctccgtagcattctgcaagctaaactgtgggtgccaatcggtaagcactatcaccagttattagataatggctggttagccgaatctactagctagttagtcacgaccagtcagccgactcaagagacaaataagccctccaagcaatatgcttggaaggcttatttcattgccagtacacctgaagcccagtcgcggacgcaccaccaaattagtcccgctataagctagttatcgaacagcgagtcgccgaacaagttaaccggtggggcactttgaccagccaccgtctcctacagccatactggtagtagcggctgacgccatcattaaaaggcgtgggccgtcgtttcaccattcagaattgctaagacgtcatccaggctaatatcgaccatgtttttgaccgctaaattcgtatagaaacccacgtgtggcgtgataatgacgttgggcatctgcattaattgtgccacgttggtatcttgaagcacctcaccctgatgattttggttaaataacgcattttcaccctcaaccgtatcgagtgcacaaccggcgatttcaccggcctttagcgctgccacaagatcatcggtgacaatcactggtccgcgtgaggcgttgataaggtaggcatccgtcttcattaacttcaaggctgccgcatcgatcaaccccgcagaggtctcattcaaatccacgtgtaaatcaacgacatccgcccgccgcaataggtcttccttagtgtcaacgtaggttaaaacgtcttcgagttcaggatggcgtaccacgtcataggcaatcaccttggcacctaacccgtggaaaagtcgagcggccgtgccaccaatacgacccgcaccaataataccaacggttaatgatcgaatttctcgtgcttgcagtcccgcccactgaaaattctgttggctgattcgttgatcaaacatttccaagttgcgaatcaagcgcatggtttgtgccaccgacatctcagcaactgaattaggcgaataggctgggacgttcgtgaccacaagaccagccgccttggctgccggaatatcgattgtatccacaccagccgtacgactcgttagttgtgtttttaacccggccgcagctaatgattggtataagctagcatcaccaccaattggactgcgttgctgaatgaccaagccgtcataacccttgaccaggtcggcagtttctggatggaattccagatcattcgtatctacttgaatttgatgagccgcagcccacgcttgaatcgcatcctgttcatcatcgcgaacactatacattaaaattttcatctttaagcccccgcttcttgctggcaacgtacgtcctgagccgcgtgaccgccgtcttaagatcggccattgaagcggcataactaattcgaacatagccttcaccacccgggccgaatgagctacctggaatcagagcgacacgtgcttcatgggctagttcacggcaaaaagccatactattttgtggcaacccggctggaatcttactgaagagatagaaggccccttctggcttagctgattggaacccaaggtcattaagtgcatcatacaaataatcgcgccgttcttggtactcacgtttcattacttgggcatcatctaacccatttttcaatgcttccgtcgcagctgcttgagcattggtcgtcgttgaagtcactgtgaattggtgaatcttacccagttgtgctgtgatagctttcggcgcacacatgatgccgattcgccagcccgtcatcgcgtgcgactttgagacgccgttaagcaaaatagtttgtgttggtaagtaatttgcaatcgattcatgaggctcaccatacgtcaattcgctataaatttcatcagacaaaacaaaaattggttgatcagctaacactgcggccagggctttcagatcatcatgccggtaagtcacaccggttggatttgaaggaaagttaaggaccaccgctttcgtcttggggtgggctgctaacgtcgtttgtaactggtcaggcgataacacgaagccattgtccgaggtatccatgaagactggtgttgccccagataatttaactcacgattgcgatgtacaatggaaaaattggggttggaatcaggacctcatccccaggattaaggattgaagtcaacgctgtataaatgcccccggtcgcaccagctgtgataatcacttcgctagcaggatcataatggacatcatacttagcggccaagaattcagcggcagccgtccgcaaggccaacgttccgttcgagggtgcatagtggctttcatccgcttcaatgctttcgattgcagcttgtttcacgtgctcaggtgtattaaaatccggttcaccgagggtcaaacgcacgatacccggaatatttgcgatttcagcgttgaacgccaaaatatcagacggctgaatcgccgcaatttcatgattcatatggttaacaagtgtttctgaattaattgacataaagattcctcccaagtttggctgatcttgttggtggaagcggactggactagggtcaaaaagcgcacccctcgaaattccaaagggtgcgccaccacgcagaaacaaacttattagccacccttggaattttcaaacatccatgggcgccgtcaaatcacaaaatactcttggcaaccgcatcgatgcaaacatcggattcgtgtttgcacctctgcagccggcacaaacactagcgaaaataccaaaagtaaaagctagttctagattttaatgaatttaacggtaatgacatatcattagctcctcatcaattgttaatctaactataatggttgtcctaaccactgtcaaggacgaatttgctatactggagttaaatctactttggaaggaacgattatatgacttaccaagcattaatgtttgatattgacggcacgctgactaatagccaaccagcttacacgacggttatgcgtgaggtacttgctacttatggcaaaccatttagtcccgcccaagcgcagaagacttttcccatggccgctgaacaagcaatgactgaattggggattgcagccagtgaggtttgaccactttcaggcccaatacgaagatgtcatggccagccattatgatcagattgaactttatccaggcattaccagcctctttgaacagttgccgtctgaactaagacttggaatcgtgacttcccaacgacgaaacgaattagaaagtgggatgcgctcgtatccattcatgatgcggatggctgtcacaatcagtgcggacgatacgcctaagcgcaaaccagatcccctcccctactcacagccctcgaaaaagtcaacgttgcgccacaaaacgcactcttcatcggggattccgtcagtgacgaacaaactgcccaggccgctaacgttgattttggactggcagtctggggaatggaccctaacgccgaccatcaaaaagtggcccaccgcttccaaaaaccattagacattttagcgctttttaaatagccataccgacaaaacaaccgtttcgagccactgctcaaaacggttgttttgtgtttagattttcaatttggctaccgaaacgtgcttccaaaggcagtttgctccgttttaccgttaatgctcacaaactaaccgcctttggaagcactcttaatcttctcttccctcatacgcaacttgcgcggttacctggtaatcgcccggttgctcgatagccgacgttcggcccgcaatcttgctcataccacctgtgattaccgtggaggccaagtacaacttataatcctcatgcgcatcatgaacatcggtcaagccgaccttagtaatatgcccaaccggggattggtccatctgattgattccggcgtaaataactagccggtgattctccaactttaactgcgaaaaaggaatttgaatgccttgcccaatcgcataaacgggttcacccgttgctcgcgcctcgctgaatgatggcatcatcagttaagccaccgtaatctaatcggacaatgttcgccgcttgtagttgatcaacaatttgatgcacattctcctgttctcagcacgtgaagtcttcaccgtggcgggcaacaattccgcccatcaaaaataccgttcgcgaggaatgtatggttgttgctgactttgttgtgcttgtttttcagctgctaacgcttctttaggcttaccacccaacaatttttcaatacgtggtgataagtcatacttcgcagttttattagtaaaataataaatgacgtttaacgtaatgaaataaatcagcgccaagaaaacgagcatatataagatgccccgtaaccacgcgccattctgcatcaagcgaattgccacataaccgaggtataaattacccgcaattccaatgccgatatagatttggttcttaatcttcacattgacattaacgtaacccaaggcgtggttgatcatatctaaaatactaaacattcgttattcgcccccgtcgctagtagtggtatccgttgtcgactgtgacgttgtcgttgtcgagcttgacgcggtcgtacttgatgactcagcagcagagctttcatcatcgtcactcgtatcagtcgttgaactattgttatcagtcgtactactattagtggcactagaactcgtatcatcagctgaacttgatgaactactggtcttattagcactgctgctgtccgtatcattctcgtcagtactactactggaactactattctgttcatcattagatgtatctgaactggatttgtctttggatttattctcatcgctaatatcatcagccgctttctttttcagacttgcggaactagctgatgaacttttgaccacactgctagtggccttggcgccattgacagtatgggttgtcttattaacgaccacgttagttgcccccagtgcaaggacaattgaaacaattgcaaatggtgaaataaatggtggtgttcgataagccatcgatgtcattcccttctgaggctttgccgttattctttctaatctataattaaaccatgctcgtgttcggaatgcactaattctatcacaaattaagaaactctttactcaaacaaggccaacaaaaagccgactccccgtcagctattaatttgctttttcgtgcaattggcacatagaccgtaaatctcgatgcggtgacccgtaatcgtacaacccggtaattgtgcttcatactcgtctaacggacacgcttgcagttccgtcaccttaccacagtttgaacaaacaaaatggtgatggtgttgatgcttgaaatcacattgatatttaaccagggtttgattagcctgggccttcaattccaataatcctaacgtttcaaactctttaatattgcgataaatggtattgtgactcattccgcaaataaggtccgcatgtgctcatcaacggccgaaattgccacatagtggtcctgataggtcaccagataatctaataatgcccgccgttgcttcgtaattttaaactgattgcgacgtaaaattgcgacggcttgttcaatttgggtgtttccataatgttgctgcctcctactgaccaggacttcactaaatcataatcattactatttagtttagcatactcaagtgtaaaagtgaattacgttgaccgtctatacgtcagcgctaatctttcgtcacaacatcatgctgacaatattcagtgaccagctcatctagttggcgccgcgtcgcccgccaatcatcattcacgataacatgtgcatgccccactaatcctactggcaaagcctggtcccgcaaatactcatcactagcaactcgctttttatccggctaggaagatctcctcgcttggtcaaacgctgaattagcgcctcttgatcagcaacctcgagataaatcaccaccgcttgttcgcccaactcccgcgcataggtaatagcccccgccgtatctaagacaatactaatcagtggtgaccgttcccaggctgccgctagtccttctcgtgaagaaccgtattgattaccactataggtcaacgtgttctaaataatgtttcgtggcaaaactcgccggagtttcaaaataatagtcgcgcccactgacttcaccttcccggggagcccgggtcgtatgagtaatcacctgaggaatttggtattgtgaccgcaagtaatgactgacagtggtcttaccactccccgttggtcccgtgatcacaaagatccgtttcgttgtcaaagttgataaacctccattttttaatccatgtaaagcttttcatttgcgttagctcggtaaaccgagtatagtaacgtacctataaggttcaaatagatgattcacgcatctcgtagcaaaccaacaattttcagaagggagttttgtcatatgcaatttcaaaaaacaaatagctggttcagcattgtcttagatacgcaacgccaaatgtttgtcgcaactgacaaacttcatccagaattgttcgctgaaggcgtaacaatcgaagatgcagttgcaaacttacaaacccaggccctaagccaatctaaaaatattgtttaaaaattactggtaccgtttatgcgacggcaccagtaatttttttacagtcagtattattgtagatgctgctcaatgtaggtgttagcctgatctaacatttgctttaaattatcgtaagtcaatcgttcgcgggcagcagcataatcaaaccagccaattgcactgatttcagcttgctgccgcgtcactacgacaccacttgggacttcactgacaaacagtgtgacttgcttcaaattaccattcggtaagtcatattcggtatacgccttaaaattggtatcgagtgtcgcttcaatttgagtttcctcacggatttcacgtcgcgccgcctcagctaacgtttcattgccttcaacgtgccccttcggaaagccccaaaaatcactggtcgcactctgtaataataaataagcgggatgaccatctttttgttgatagacgaccgcaccactagctacttctgtactccatgaagtcgcaccttcctaattatgaattatgctctagtataacatgttccatcatcaattgagggctaaaattgcctggagcaagtccccagtgcaaccccttgccggtcatccgttcgattttgtgcaatcgtttctgctaccgccatattcaaccactgattagcgcgcgccagcgttggtgctaacgcgtaaccccggcccaacagtcccgcgattacagcagctaaagtatcaccggtaccattataatgccccggcaaacgtcgcgcaccacagtattgcacgtgcccagcttcatccaaccaggcacagccaatctgatcagcacgttggacatccgtaatgactgcgtgggcgccagttttcaactgtgcttgcagtgctggcaaaataacttctaaatctggcgtcacttgatagggcgctcccgttagcaatgcggcctccgtcgtgtttggcaaaatcacatccgcctgttgaataagctgacgcattgccgcgacatagtcctgatcaaagccctgatagagttgaccgagatcgccgagtactgggtcaacaactaatagcgacagcgtttgttgttctaagtaagtagttatttgttggcacagtgcgaccgaaccaacgtagccgatcagggcttgatcaaaatgcagttgtgcacgggtccaatgcgcaaagaccgcggcagccacgtcgataagtcgacaacggctggtgtcccgtacccgctagtatgtgtcgataataagcttgtcggcagtgctgccacgtcatactgcatcgccgttaatacgggcaacgctgaactaagtgagattccaccgactgcggataaatcttccgccactaacattgttgacaatcttgctaccccctcttatctcgtgtaatgcttattctatcagaactccgactgactgtaacctcttcgcttcaaaagaaaggttaaatcaaccactcaaatgggcattgattactcatcactgcaaaccgcaacggtattgtcatcattaagcttgattagtgccgactcaaaaagttgagcagcggattgccagtcccgttgttcaactcattaaaatttatcatccatcctcatcagactaagcacacattacgtcgaagcccttcgacacttaaccgacttcagttccttcaaatattatccacaatattagctagcctacaatttgctagtgaatcctaacgtgggcatccgacagtttcagttatcagatgacgttaaatattgctgttccatagcgtgccgggcccgaaccgcatcttcaaaatgcgcaaaatgtttgtttaatatgtacgttcctttgtagtagaagtgcgcaacccaggaacctgactgtttgtcatagctcacgcccacgaccccactcgtgttacgcttcgacttcttgattgaactcacatctgtatggtgatcacgaatcttcaaattgcgcgggtcccccatatgcgaaactgcttgcggatttattaaaaatattttgccgactctgttccacggctagacagccacaactacgcgtcttgccgtgccgcaaaacgtaggaatccaccacgcacgtccggccacactgacactgacaaaaccagagcgcattaccattcttggcccggcccgctcggtgaacagctattaagcgtccgaagtgctgaccggtaatatcaatcgccgctcccatcctaatcccaccattctaaaattaaatttctattgataacaatattataagctttggcgaatccaattaacagtttaatgtattatccgtgtgtattctttgactaccgttcgttataacaaagtatcaacttataaataacaatagtaacagctacccaaccgcatattcagacccgtttctcttcagcttagcaccgttaccgccggcttaagtgatgactagtaattcggccatcacaacgctttttaaatccccaccatgactggttacgcgttatcgtcatgtcaaatctattgtcagcacgaacattgcctcgacagtcgcaatgtcaccagcttctatgatgattaaccagctatcttgctccgtatcccattgagttattaataataaaaggctgattctaattgacttttaataatcaaccacggtatcatattgacatgacaatttgtcgataatgacaactaactgttacaaataaccaaaaaggtggtccatgttatggggattttccagcgcattttccaaaaagaagatttggagcgctatttacaaaaagatagtcattttgaacgaaccctctccgcagtcgatctgattgcacttgggattggtgccgtcattgggaccgggattttcatcctacccggaacggttgccgcaacaaaagcgggacccgggattattttatctttcgttttggctgccattgtgtgtgccgtcgccgcaatgtgttacgccgagtttgcttcggtgctcccaatcgccggttccgcgtatgtcatcatacggaaacattgtctatggcgaaatgattggttggatcattggttgggctctggtactcgaatacgtcctagccgttgcgaccgttgccgttgggtgggccgcgtactttaattcattcattgctggttttggcctcaagttaccgaaagccatcaccggttcgtttgaccccgcccacgggacctatatcaacgtgatcgcaattctgattgtctgtctgattgcttggattatcgataccggcctaaaaacgtcgattcgattaaacaatattattgtggtcgtaaaattagcaatcattgtattgttcttattagtcggttcattttatgttaaaccaagtaactggacaccctttgccccatttggtgggacgggaattctcaagggcgccgcggtcgtcttcttcgcttacttagggtttgatgctgtgtcttcgtcggcagccgaagttaaaaatgccaagcgcaacatgccaattggaatcattgggacccctagtcatctgtaccatcttctacattctcgtttcaggagtgctgaccgggatggtttcgtacaaacagttgaacgttgacgatgcagtggcgttcgctttacaactcgtccatcaaaacttcgttgccggtattatctcgattggtgccctcgccggcatgttcacaatgatggttacgatgatctacagtagctcacggctattatattcaatcggccgtgacggcttactcccacgtttcttaggtaaaatcgataagcaccacgcccctaaaaacgccatgttgacggttacaatcgtgatttcaattcttgctggtctcattccgttagaccaattggcaaacttggttaatatcgggacattaattgccttcgccttcgtttcttttggaattttgctactacggcgtaatcccaagctcaacgcgatcaagggcttccgcgtgccactttacccggttctcccaattatttctggcttgctgtgcctgttcatgatgacccagctatccatggaaacttggctggcatccctagtctggttcctccttggtctcatcatttactttggctatggcattcggcatagtcgcatgaataaagctgatgagtaacaatctagatttgtactaactaaaagcgcccatctcaagtgatcaatcaacttgagatgggcgctttaactattgtcagccagctaacgatgacaacgattacattttaaggtatgataatgatacttaattaaggagcgtggtttaatcatgttaacacctaaaacgatccatgacgaccttcatgagcatcatacccaggtcgttcaactattcagtaagcatccctggctcattcccgccacaaccttattacacattattccagttgtcgtcggcatcaacggcttttggaaatcgcgagcactaagcaagcagctcaaaatcgaacgcgaaaaacgaagcaacttgccctacaacaggtcgataaagttcagaggtcagcagttactagtcagcacccaagtttacgccaacttttcaagcaaattcgcagtcatcattaacaccaacgtggttcgaattggcagttttaatcgctgccaactcgaaccacgttttaatcaatcccctgacatttttacaaactacgattaatgattactgcggccatatcacaacggttaagccaattgaatcgtcacgttggctgatggcccaacgagcttggcaacgggacaacgcgtttccgcaatcgcgagccaccgtgctgccgtttcagcatccacttccggaatcgtgacccgagcatctaggaaaaattggtacccaaaacggtcacgcgacatcttcaccgtagtcacgactttgctctgatgtgtctggccgtgctccttttcgattgcctccagcgtcgcgttaaggcatgtactgagcgccaatccgattaattgttccggattcgagcccggcaccgccttaagtggactagatacggcccacctcaagaccattgggaatataggcgtgtccttcgatgccgtcttcattaactgcttgggtcgtatataaaattggaaaatcactcaatcttagttcctccattcgatagttcactttgcaattaacctaccacaacattataaacttgtcagtaagaagcattggttctcgactaattagcggtataatatttctaataatacttaatggggaatttacttatgaaaaataatcaatttgcaatcgtcccgactgattcggaaaccgcgattgccgaacttacaaaaattcattttattacgcctgatatggacgccctgacgactgttccagccgtctaccaggcattgctggctaaaagcttaccagaagttcacacggcaagcggcttgacccacaagtttaataacatcatggcaaccagccagcacactttatcagaatggctcgccgatgcaactatcgtaaacaatcaagtcttttataacgtgggacttacagctactgggttttctacctggtcaagattttgaattggccgatccattgctggcgatgcgcgatattcacttgccaatggtcggtgatagcgcctttgatcgtgaagccctctattatgcttggtacctattattaaatacacgtgggaataatggacaaaccttgattgaatcactcacgacccggggttactttgtaccattttaccaattacctaacgatcaaaagccactcttcttcaatggtaaggcccaagccgtctttgataccaacgcgctcattcgtgacgtcgtctacgttgaagcgcctttagatactgaccacgacggccaacgggacccgctcaaagttgaaatccttcggccagctgagaccgaaaccggcttaaaagttcccgttctctataccgctagtccttataatcagggcatcaacgaccaagctggcgatgctcaaatgcacaacgtagacgttcccctgactgcaaaggaaccgggacgaaaatacctatgcggatgttgagttccagccaacaacggcgcaactaccagccgctcgaaccgcgaccacgacgaccgatacagcagaggagactttcagccgagaaaagtcctacacgctcaatgattactttctagcgcgcggttttgctgtcgtctatgcagctggaatcggttcgatcgactcggatgggctagcccctaccggtgacgttgatgaaacgacctcaacagttgcaattattgaatggttgactggcaaacgccaagccttcaccaatcgtgatggcaatatcgctatcaaagcttggtggtccaacggcgccgttgctatgactggccggtcttacctcggtaccctcgcaactgccgctgctacgacgggcgtggctggccttaagacgattatttccgaggccgccatctcaagctggtacgactattatcgagataatggcctggttgtcgctcccgatacgttccagggcgaagaacaccgatgttctcgccgctgaggtcttctcacgaagcttaaaagccggtgacgctcaccagatccaacccgcgtttgatcagaaactggcagaactgactgccgaccaagaccgagcaagcggtaactataaccgtttctgggatgaacgcaattatctcaagaacgttgacaaaattaaggcggacatcatcatggttcacgggctcaacgactggaacgttaagccccgcaacgtagctaatttatgggataaattacaggcagttcccgttactaaaaagctcattttgcaccagggacaacatatttatatcaataacttacaatcgctcgatttcaccgacatgatgaacttgtggctaagccataaattatatggtttagataatcatgcggagacactcttgcctaacgtcttggtacaagacaacacgcaagcccaaacttggcacggctatgacaattggtggcaagacacaaccgacgctttagatttttaaggttcagtacaaagaattagttcccgctgaccatacagttgaccaacgcgccgctcattttactgataaattgcctgacaaattattcgaccactataagcatcatttggatagttggcagcgcgacctcttgcaagaggataagttaaatccgctctatgattaccgcctcttgttcaagtcttggcaggcacctgaggatcaattattagtgggtattccgcacgttgcgggctctgtcgccgttaataagaatttcggcatgttgagctttatgctgattgacttcggggccgcgcgccgtttgactgtcagcccacaaatgctggctgcaaaagcgcttgatctaggttaccactggcgcgaagatgatttgaaggacttcaagttagcgggtgagacgccgttcaagatgattactaaggggcatcttaacttacagaaccgccaccacccatggcacgcagaagcgattcagccaaatgtcttttatgaacttttctgtggatctccaaccgctgttccaccacttgctgaaggggcatcaactcggactagtcatttacgcaactgatatgaagatgacgattcgtggcaatcaagacctacagtactcacttaacttgaacgatattcgcttacacgtcccaatgaaaaaaataacagactaactaattatggcctaccaactaaccacacaaccgttaactggtgggccttttgtgtaccttcaacttaaacagccacttatcatgaccaggtcggacaccaccacctgtccggaactagccaaaaaaaagttccagcttaccatcaacgtaagctggaactcatctttaattgttattaacttcggcaatgcggttcgcaatcaaattcgttaactggcgattaccagtcgtatttggatgaacattgtcatctgcaaaccaaccactttgattctgcgcacgaccatgccaatcgataacatgcacgttcgcatgcttcttagaccagtcttggcaatttgagcattgacctgattttgccaactctgtgttgggacgtgggccgttacccagaaaatctgacgatccttaccaatcagtttaacgacttgttcagcttgatcatccgtaattgtcccgttagtcccaatgttcaataggacgttatgggctaattgcccttgcgacttcagcgaattaatgattccaggaacttccgtcacttgacgaccaacgcgaccttgaaccaccgtacccgggataacatcttgaagatcggaagaaacatccagtaacaccgaatccccaatggctgtcagatccgtattggccatcgctagaacaacttgtggcttcaaatcgtattccttttccaccgcttctgcttcgagttcaacttcgcttcagcccgcttggtctgcatcttttcagtcgcaaccttcttgcttgaagcagccgctgcctgggcagctttttgccgtttgagcgccgccgcattcttcttcgatcagccgctttagagttagctgcaatcgtcttttgtaattcagtcttcttgttagcttccgctttacttggctgttgaacgaaaccaaccgccgtaataacgaataagaccgtggtcaaagcgacaatcgcagtggtcacgcggttaaacttcggtttgcggaggaaatctttgaagtcgaccaataaccgactgtaatcatagtgccgcattggattttcaataaaccgataactcaattccgtcacgatcaaaattaaggcaacttcaatcaaactattgaggagtaaatgatcaccaatgtttttaactttagtttcgtagaaaatcatcactgggaactggtagagatagatcccataactacgttgcccaacgtacttaaacaccggattcgtcaagacgcgattgagatgactagccgggtgggccaccgttgcaactaacactgttgataggactgtgaatagtaacataccgccacgataagtgaaatcaggattgaccggacatctggaaaaacatccaaataattgcaattagcgaagcaccgcctaagatatccagtgtcactcgattaacattagcaatgtccgccgataattcccgtgatggccagataaacgcaaggccagaacctaacaagattgcaaacatccgcgtatcagttccgtagtacacccgattcgtattcgctggatcatacaacattgccatggttatcgctgaaatacccgcagcaatcatcataaaccagaagacccgtgaacgcttcttgaagatgaccatcaagataccaatcactaatggccagaataagtaatattgtccttcaattgagagcgaccataaatgagtgaacggtgattcaccattgaaacggtcaaaataactttgaccgtgattgatttcaaaccaattatagacgtagactaaattcgttaatacagtagcccgaatgttcgtcaataatgaccgttgaaacagcgtaatgtaggcctgttgtccctaacaacatcgtcacgaatgctggatatagccgccgcatccggtgtccgagaaaccgccatatccggacatgcccccgactcaaaatatcttgtaataaaatatccgtaatcaaataacctgaaacgacgaagaagatcggaactcccaagtaacctccttgtagtgaggccggcatcaagtgatagatgatgacacccagcaccgccaatgtccggataccatcaaatccggtgatataacgtcttggattcatccggtgtcgattcatccgactcattgttcggctcatatttacgctccgcaaattttcattcatattcctattaccccttgaattgtctctacaaatattaactaacccaccagtgcttcggtacctttactataatatgtaaatgaccgcattgaccagcattatttaaacttcattaattatttttattaaccactttattcattatgctgattaaacacatataaccccgagcaacttaattacaatataaataaatcaaacgtgagtctattaatccatccgttatcattcctatgttatcaacaatttaaggttgattcgacgtaccaaacagctcaattaatcaaattgaaattgattagcactacttgtgactaacttctactatacaacagtatgaaccagtaaaacattgaatcagaaatcattttaaaagattgacgcgattcgttcggtaacttgataaattgattttacaaacttgctagccatgataaccaccggacaagaggttcaccttagtaatctcaccagaactaaaatgacgactctgaccagtctctaatttgacgactaacgccccgtgtgcatcaatatccgtgacaactccacgatacttttgcgttccgctcttcaactcgacctgttgatcgatcaccatggagagtttccgataagcgtccatgaaagtcccactacgataagtcccatagctattgaaaaagcgccgcagcagtagctcacaaatcacttgattgcgcgtcacaccatttggattggcaacgactgcgcccgctttgtgcgctagtagcgctggaaaagctgtcgttgttaagttaatgccaattccaataatgactgctgaaatttgccccgtttcgagactagtgatgccttctgataagataccaaccaccttgtgatgattgactaacacatcattgacccactttaatgaaacgtcaaccgcaaacagctgttgcagcgtctgagcaacgactaccgcagtactcgttgtcaacaaaccagcgtctaacgccttctggtcactgagtggtaacccaatgctcatgtaaattccagtctgtgctggcgaataaaatgcccgccccgaccgaccgtaaccagcagtttgcgtatccgcaaccacgattttcggaagtgctaaaggcgtctgcgtgactaaccgccgtaaataggcattcgttgaatcaaccgttggtagcatggtcaaatcaaacggtggtaacgctgtaagcgcgtattcaatcaccggcgcactcaattgattattggccacataccgataacctcgcccatgccggctctcaatagtatggcccgccgcttgcaatccttgcactaatttccaaatagccgttcgactgattgcaagtcgttgtgccaaccagtcacccgaacagtacgcgggcgccgcttggattaacaagcgtaaaactgcgacttgatttgccatatcaatctcacccatctctaattagttaacccattatttcatattggttaactaaccgcaattgaatttaaagaatgtaatattacatctttctgtgctgagcagtttacttattatcgctgaaaatgtaaccgcttgtcaaatcaattgtgtacaatcggtcacaatacgactgaaacttggtctatcagtcgtaccgaccagcataataactagtataaaccaaattcagactaaacggcccgttctaattattattttttatatcgtttcgaccgaattcccctcccatgctcagctactatgacgcgaccgtactgattcagttaattagcgaacacgaccttaccaattatctacttaatgcaattctttatgattgcctagtctctttgaccccgcttagttaacagtggtaagataacaattaaaatatgaagaaattaggtgatcatttgaaacaaggaacgacaatcatcacgctggataatggctaccatttatggacgaatactcagggcaaaggcgacattcaattattatgtctacacggtggccctggtggcaatcacgaatactgggaaaactttggtgaggaactggcagatttaggcgtccaagtttcaatgtacgaccaattaggatcctggtattcggatcaacccgactactcagatcctgaaattgctaagaaatatctcacctacgactacttcttagatgaagttgaagaagtccgacaaaaactaggactcgataaacttctacttgattggtcagtcttggggcggtgccctcacaatgatgtacgcgctcaagtatggtcaacacttaaaaggcgccattatttcaagtatggtagataacattgaggaatacgttgtcaacgttaacaagtgtcgtgaagaagccctaccggctgacgctgttgcttacatgaagcaaaaggaagcggaaggcaactggaatgatccccaatatcagaagtacgtggacgttctgaacgctggctatgttgaccgcaaacaacccacttcaattcgccatttgatcaacaccactgccactcctgtatacaacgcctttcaaggtgataatgaattcgttatcactgggaagttaaaggaatgggatattcgcgatcagattcacaacattaaagtgccgaccctgttaactttcggtgaacacgaaacaatgccattagcttcggcccgccgcatggctcgtgatattcctaactcacgcttagtaacgacacgccaaatggtggtcatcaccacatgatcgacaatgcccccgtctactttgaccatttgaaacaattcattcgtgacgtggaagatggcagctttaatcaaaaataaatcctaactgaacaattaagaagccgccagtatcaggtcatacccgatactggcggcttcttaataatattaggttaactgaagctttgcccagtgatctaactagcccttcaggctttaactatagctgatcaccctgtgctcgtagtaaggcgcctaatgatggctgttccttaatatcaatgtggttggctttggcataagcgtcaacttctgcttgaccatataattcaggatctagtggcatgtaagctgtgccaattggatcatcattcttgatgaccgcgttcacaacgattggccgcttgttgcccttcgcttggagcgccttgatttggtcaaagacggtttcgacctcttgattattttgaacagtaaaaccaatcccaccaaaaggccatctgcaactttggcccagtcggcatccgttagatcaacaccatacaagtgttgcttcgtatcaacttgctcacgatagatgaaaccaaaccgttgattactgaaaatcacgttaataacgggcaagccgtaacgtgcttccgtgataatatctggcgctaccatcgcaaagccaccatcgcctgagaaactccacgcttggctgtctggaacacttaaggcaccagccatcccagcgggtagtccaaatcccatggttgcgaagaggccagataaggcaaagcgttgctcctgatccattgggagcccccggacagcccattcggagacgttaccggtgtcgaccccgtaggtatcacgagggccgaccatactagcaactttgtgcatgaccgcttccggcgctagtccatcatggtcgtcagcagccaattgttggagccacttatcccaattacgtttattttgccggttagtcgttaaccacgctgtttcaggtaacgtttcgccagttgcaatcatcgcttgcaaataagcttgggcgtcactgatgacggcgtaatcgattgggaccatcttgccgatatcaaaactgttattgttgacctgaataatcttaatccccttaggccaaaaactagcaaatggaaattcagatcccaggaacaaaatcaaatcagcgtgttggagtgcttcgaaccccgatttggaacccaaccggccaaacgtgccaattgcattcgggtggttcgttggaataacccccgtcgccgggaccgtattcatgactggaatattgaattgttcactaaacttgaccaggtctgccttagcaccaagaagaccccgaccagcgtaaactaatggatgcttagctgcttttagcatctttaacgttgccgtaatggcctgaggatcgacccgttgttcaaacgtatctgaaacggtgttaggcgtcgataccggctgataatcgatttcttccgctgagagatttttttcaggaatgataacgactgccggtcccttttgccggtatgcttcacgaatcgcttggttaatgacatatggtaattgtccggccgtcgtgacagtgcggttatataccgccacgtcactaaacattggggtctcatccatttcttggaagtaattcgtgttcatcgtcgcttgtggtacctgtccgacaagtgctaatacaggaacgtgatccatcttggcatcatacaaaccgttgaataagtgcgttgcaccaggacccgcagaaccaaatgaaacgccgattttgcccgtaaacttggcatctgccgaggctgctaaggcccccacttcttcatgccgtacttgaatataatcaatatcggccttttcaaggtacaaaccttcaacggtatgattgattgaaccgccgggaatcccgtagatgtggtccacaccccacgcctctaaaaccttaactaaagcttgtcctgcaatcatctttgtcatcactattcatcccttcgacttagaaccaatttgtctgcttggttcaattcatttaacaaacgtattataaatcgctttcaattataaatgcaattaatatgcttacttttcgtaagtgaaattacaagtacacaaaacggggcaccattcagcgccaattttgtgtttatccgattatttcatgtgaaactatctatggactagaaaaataggatcaagcacacacccgatactcagttttatcaaatatcgctaacaatctagcacgaacaacttaccgacgtgacgacaatcaaaaaccaccccatcaaacaaatcagggtggtctacattaagctttactatattgtgattgttgatgctgggctgagacagaactgaccacttgcaaagcacgctgctgccactgaacgtccacatctaataccgaggtttccggtggcaactggtatggcgaaataatttttaatgtcgtggtgactcgcagaatgactgcctgtcgataatttagcgctaactaaccaacaacgataatcaccggccgctggtaactgctgttgccgatttgcaagttggatcgttctagtcaacggatcgaatgtcgcctgtgtcgcgtaagtgtaccccaataaatcattagcttgttcaatctgcccccgagcaatcagccccggatccgagtagaactgactttaagctgctgattagccaagcgatccaccgtgaccgtttcaaagtacggggcgcccaattccgcgagttcgcgcatcccatttgtgccaccccgcccgaacgtatagtcaaaccccgccacaacgacttgcgcattcaacccgacaaggtaatccttaataaacgcagtcggtgtcaagccagcaaattggtggttaaaatccgtaatatatagtcggtccacctgtagcgccgccatatgttggcttttttgcgcgacggtattcagataccgaaaagtggtctgggacttaaacagttgtgacgcgtgtcgaattgaacgtcatcacagcgagtggtaaatcacgctgcttcgcaattcgtttcgctgtttgaatcacgcgttggtggccctgatgcacaccatcaaagaaacctaaagctaataccagtggcggttgtggtgccagcatctttaatcgatgggcatctaaattgattacttgcatctgtgcgacctcccgaacgttcacgtagtgttctctacagcttggtatgttgtcaccgccacaatggcaagcgacacttaatactatgtaccaaaagagccgcgataatcgcgtcctctttcgttaattatctatccaaattagtttgtttgagcttgttttaagaagtagctgaacggcttcaacgcttgagcatcatacttcttgacaaattcagcaatcttgtctttatcttgccatgcgtcatcgagatacatatgttccgttgtaaatggcattgcatgcgttaacttcacatcaatgacaactggcttatccgtcttcttctcttagcgtcttcaagggcttgcttgaattcagccttggtccgaacggtataaccaacggcaccatagccttcgccaaccttggcccaatcagtatctggcaaatcgacaccagagagtggttgatggctatcatcagtctgttcagcttcaataaagcctaaggtctcattactgaagacaatgttgataatgtgcaagttatacttaacttgtgccaagatttcttctgacagcattgcgaaagcgccgtcaccgctcaaactgtagacgtcccgatctgggtagttgactttagcagccagtgcagcgggaaccccaaagcccattgttgcataaatcccagaagttgcccatttctggtcatcgtgcattcggatcaagcgttcaaagttaatattaacactgccgacatcgatagcccaaacagctttgtcactagcttcttggttcaagacatcaaagattggttcggggcgaactggtgattcagtgctatcgttgaagctggcttgccatttgtcccagttctttttatcagcaaccgcagcgtcataaaaggctgaatcatcgcgcgcttcaccagctgcattgatcgccgctaaagctttttcgcatccgcctgaatagcaacgttcgtatggtggcgcttaccaaatttttcactatcaatatcgatttgaatgaccttagccttcttattaaataagaagatactgaatggaacattgttaccaacccagagaattagatccgtactaaatccaatctcggcacccggcttaggtgcgacccgtcccgtggaacctaagtaagcgggatagtcgtcttcaatgatccccttcgctaatactgaagagacaagtggcatcttaaacttttcagaagcagcttttaattcttcagccgcgtccttagcgccaacgccaaagtaaatcattggtgacttagcagctttgattaatttaaccgcatcagcaactgattcagcggttggtgtgcgcgggatagttaacagtgtgcacgctagcgttcgtttcaaagttgtcttcaatttcagcccaaccaaagtccttagggatcgttaagacagctacaccattgtgggcatacgcttgacgaatggcttcatcagtcatcatcggtaaactctcagcagtcatcgcagtccgattccaaacagccacatcgtcaaaaatcggttcttcattcattgcttggaagaagtccatgttcatccgcttagtaggaacttgtgcaacgattgctaacattggaataccatcttccttagcatcgtacaatccgttcagtaagtggacagcaccagggccagcggaaccaaagcagacgccgatctttccagttagcttataatcagcggaagcggcaatcgcaccagcttcttcgtgacgtacttggatgtacttcaacgtttcccgttgattatagatggcgttcatcgttgaatcgaacgacccaccgggcaaaccataaatatgtttttacgccccacttctgaattacttttaatacggcatctgaaccactaattttagccattagtaatgtcctcctctgatatattttaattatcaactttacgactttattgtaatcacgaattttcaaaatgtaaacgcttttattaatagattttatctatcattgaaaatttcgcgaaactttctatggtttacaagcgttaacgacaggctttggagcgtttttaatttttaaaaaaaaacgtatttttttgtatttttatattttgtattattttcgacaccggtataccaccttaaccaccgtactaattgtgtatttgtcttattaaatcgaattggtacgggtacatccccactcgttacgcttgccccgcttagcaaatctcggccgattgactgcttatgagctagtttcaagatagcttttgatgacgacgcttacatttcaatgtttatcctaactttctgattgcttcacctccccttctatcacttgaatgaatgactctagtatagtcacctccaaagcaaaccaacttgacgctcatcaagttttagcctatttcacgtcaaaaagactaccaacgtcatgtgcgtcagtagttcgtttagaattaagtcatttaaattatctgtaactagccaataacgtcgagctgaccacctttaactgtcagacatttaatatccacaagaagataatgaagatgaagaacagcacgtacattaatggatgaacttccttggcatgcttagttgcgaccatcgtaatgacgtatgcaatgaagcctaaagcaatcccatcagaaatactataagtcaacggcatcccgataacagttagaaatgcgggtacggcaatttcaaaccgttcccaactgatctgttttaaagattctgccatcaacacacccacaataatcaatgcgggtgcagtaacttgatccgtcacgacgtttaataacggtgagaaaaataatccaagaatgaatagcgcaccagtaacaactgcactcatcccagagcgaccaccgaccgcaattccggccgaagattcaacataagctgaagttggtgaggttcccaacactgacccaactaacatcgaagttgaatcggccatcaacgctttaccaacccgcggcattttattatttttcatgaatccagcctgttctgccaatccaactagcgttccggccgtatcgaagaatgtcactaataagaacgtcaaaacaacaataatcaattgtaacgaattaatatcaccaatatgaccaagcgccacaccaaacgttggtttcaacgaaggtgctgccgaaacaattgtggatggcatcttaatcaagccagttgctagccctaaaatggaggttaaaaccatcccgataaaaatcccaccgggaactttgcgactcatcaaaatcaacgtgacgatcaatccaaaaatagttaaccaggtcgttccaactgtcaatgatcccagaccaacaaaccgttgatttgttggcaacaattaagccaccaccatgaagaccaataaaagcaatgaagaacccgatccccgccgaaattgctaacttcatatcccgcggaatcgcatcaataatcatttcccggagcttaaaaatcgtaatcaagataaaaatcacggctgcaacgaacaccccagccagagcagtttgccatttaatgcccattccgataactacggaataagtaaagaacgcgttaacgcctaatcctggtgcaattgctatcgggtacttagcaactaaccccatcaataaacagcctaacgctgacgctaaggccgtcgcggtgaagacggcgcccttatccatccccgaagccccgaggacgctcggattaacaaataggatgtatgccatcgaaacaaacgtggtcaagccagccagcacttcggttcgcattgacgttttcaattctgaaaaattaaaatatgccgcaattttattcatgattccctccacaatattcgcctaaattataattgcacaattgtaaacgttcgtgttttagcgttcttttaacgtatttaatcgtatcattttgtttatttaaaagcaataaccgaacgctaaataattttgaatctatttaattgcgatttttaattttaatgagccgcggtagaatgaaattgataaagcgtgttcattgccttaaaaccgctcttggtcctcacgaccctcaggcaaacaacgcgtcacgattctccatacaaaggtgtgatttaaatggctggttccaaaattacggcaatcttctttttaatcctctacgccgtcctactctacttggtcttcacaatgcagaacatgttagccatgtacttaatggctattgggatgtttcttgaagcttgcgaaggggtttaccataatttcttcaagcattgagcgctacacgtatcacagtgaagcaagtacgcccatttgagtgcttactttctatgaaacgaccctacttttagtagtacaagtgtttttattcaatgggtattcgtaacaaaacagacttcttaagaattgtgacaattcctaagaagtctgtttttgactagcgaccaaaatagttgctcatcaatactaatttagtggttagtcccatgtacatcctagtgtagaacggggtgtgactgtggctcacccaggtccgtgaccgctggctaaaggtccccatcatcttgagcacttgatcaatctgtggtgcgcccaactggttgacccagtgatcaaaatgctgggtaatggcttggtcgacaatccgttcgacttgttgtccccgttctgttaaatgtaagtagagccgccgccgatcacgcggatctggcacctgaaaaacatagtgttgcattaacaatgatttgacttgccgtgaaatcgcgcttcgcgttacttgtcgctgaattgcaatatcattgagtgtcacttcatcagtcgtggcaatgcgccgcaatattaaaaattgtttcaaatgacagtttattttgacttaaaggccaagccactaagtccatcataattttggttgtattttgatatgcttcaaaataatcattgagaagtttgcttaattcgtcactgttcatcgcgatcaccatcacttcattaacttttgaccaaatataacatgcctttaactgttttgcatgacattacccgtaaattccaacgttaagcatcctccctaacaattttgtgcaacaaagtgtatgatgaaagtagttgaaacgcttacgtaaaaaggagacgagaccatgcccctgacacccttacaccaagttgaattgcgcttgatgcgtaccgtcatcgcaatctgtgaggctgaaaatatcgattactttttgatcggtggttctttactcggtgctattcgtcatcacggatttattccgtgggacgatgacatcgacattggaatgcgccgtcatgactaccagcgctttatcgccgtcgccaaccacccatcttgatccaaacaagtttttcctacaaaccggcgcctcagatccggactatgcactcagttatatgaagctattagacgtaaatacttacattgaagaacgcaacaacgtcaataatgcgtttaaaggcgtgttcgttgacatctttccgtttgataagattccagatgacgaagccttacgtcgttcacagatgttacattacaaattagcagacgctgcgatcccgctcaaattgaattaccgctttgtcaaaacaccactgcgcaacttgattacgaaacacacacctcagcaattagctgaagtcaatcgctataagctggaacgtgaggaatacatgcgcctgtacgagcagtcagactcccgaacttacaaaaatctggcgtctcaatacgattatgaaaaggaaattatgacctatcaggaattgaccgagctaacgaccgttccattcgaagatatccaagttaagattcccagtgcgtatgacaccatttttgacccggatgtatggtgattacatgcagctgccaccagctgataaacgagttgaaaaacatctgaacaaactaattatcgataatcacgaaatcttataatatcaactagcgtggttcaggcatactcgttacggctgagccacgcctttttggtatcttggatcaaacgtgccaagttaagttagcgttcgctaccgctgaaaccggggtaatcaccacatcaaccacctaactagtaagattcatacaaagttaatgatggccttaattacgcttaactttcgtataaaaactaaaagtaatcgctaactgtttcactactaaaatactaatttaactaaccccaacctgtgttaaacttaaattaaatacatgactttaaccttattgggggtcaggaaatcataaaaatgggggatcgccatggcagcaaaattatttggaattatgatgattaacgttcagagtattgaattgtcgattgtcaatttacgcacacattacgccaagtagaacgagttcgttccgacgtttcacttggtgaggatatttatgatcagcatacgatcgattatgattcagtggaacaagccgcacaggcactgagtggttttgttcagatcatgaacgattacggcgttaaggactaccatttatgggggtcgtggtccttgtcatccgctaacaatgccgactatattcaagaccaattacttgtccggactgggctcaagatcgactggttatctagtagtcaggaaacctacgcgttcagtcgcagttgcggtacactttccacgattcaagcaaatgatcacgaagccgacctacttattaggaatcaactctggtagtgtcggtatttcgcactacgatcagagtaactttgtcttctcccgtagcctccgtttaggaccagttcgaatcgcggaagttcttgaagatttgcaatcgagcgtgcctaactatgtcgaagttttggatgattatatttcgagtcaaatcgttgactttggtcgcttcttgcccgggcgaagagatcagcctagtaacgtcgtcatgctcggcgtcgcgccgtttgccaccctctttcgccaacaacaatcaaaagctggcgtggaggaactcagcaaagcagattttcaagctttatatgaggacgtgttgaacgcttctgaccagtatttaatggataaatacgaagttgatgaagaagacgtgcgcctaatcgtgcccgaattactacttattaacgagttactacaactcactaatgctgagaaaatctggcttggcaacgtgaccgtgctggatgggttaattattcaagaagccattaagttgggctataagaaatataactttaatgatcaaatcgtaacagcagctaagaacattgcggacaggtacaacgttgaacctaagcatcgcaacttggtcaccaaattctcactgcacctattcgaccagcttaaaccgctacaccacttaggcaaaccgcgagcgcttactcttacaagtcgccgccatcgtgcacgacgttgggagctacattgacccgcaccaacattacttacattcggactatatcttgcgggccactgaactcatgggattaaccgataccgaaaaacgaatggtcgccctgatttcacgctaccatagcgcgcaaacaccatcaaaagacattcgccattttggacacttacaagtcgaacaacgcttattagtctccaaactatccgccatcttgagaattgcggacgctttggatgacggtcgcaaacaaaaaattgataaaatttccgtttcaattcgcaatccacgggtcatcattacttgctttgctcatgatgacctcttcttagaaaattgggtattcgcacaaaaagcggaattctttaaagaagtctttggtttaacaccagtgattaaactacgggggtacgttaaatgaattattataaagaaagttattatacaaaccgtgaactcagcttggcttgattttaactatcgtgtccttgatgaagcacgtgataaggataaccccttgctagaacgtgtccgttttctcgggatcacacagagtaatcttgacgaattcttcacggtccgggtcgcatcattacgtaaattgatgtcagtcaattacactaaaccggatcccgcgggactgaccgctgctgatcaagtcagtgcaatcagtgataaagcccacgagatggtcaagcgtcaatacaatacattaaaccgctcgcttttgccattgctggaacagcacgcgattcatctcttgtcgatggctgatctaaacgaggaacaacacgcctttgttaagaactactttgatgatgagctgtacccggctttaacaccgatggcagacgactcttcacgcccattcccgttcattgggaataatacactcaacatcgccttacggatttataaaaatgaggataagaaggaccgcaagtttgccaccgttcaagtgccggacgtctttcctcgcgtggtcgttttgccaggcgcaccgaaccagtttattctgattgaggaaattatcaaagcctttgtcggctcactatttatcaactacacggtcaaggaaacgagctgttaccgcgtcatgcgggatttggacttagatgtcgccgaagaggatacctcggacttattaaaggaagttcaaaaacaattaaagatgcgtgaacgcggtaaggtcatgcgcttagaagtcgaaaagagtatgagcaaacatcaacgtacgcgactcgctaaagcccttgggattaacgaaagtgcgttatacgtcatcaacggtcccctcaacttgaccttcttatccaagctggtgaaagctgtgcggggccacgaagacttgaattatccaaaataccacgcctactatcccgcgaagtaccgcgaacaatccatctttgatcttatcaaggatcacgacattttaatgcaatatccgtacgatgatttcaaaacccgttgtggactttatccatgaagctgcagaagatgaggacgtgttagccattaagatgacgctgtatcgcgtatcagctgattcaccgattatcaagtatctcgggcaagctgcccaaaacggcaaacaagtaaccgttctcgttgaagttaaggcccgttttgatgaagaaaataacgttcactgggcgaaaaagcttgaagaaatgggttgtcacgtgatctacggtctgatcgggcttaagacacactgtaagcttgccctcgttgttcggcgagaaaacgaaggtatcaagcgctacatgcacatgggaactgggaattataacgatgtcaccgcccatttctacacggacatggggctcttcaccgctgatacagacatgggaatcgatgcttccaacatctttaacatgttatctggctattctgaaccaccgtatttccacaaattgcacatctcaccagatggcatccgcgactttatcaacgaaaagcttagacgatgagattgccattgccaaagctggtcagcccgcagttgtcaaaatgaagatgaactcattatccgatccgcagattattagtaaactctacgaagcttctcacgccggtgttaagatccaactgatcattcggggaatttgttgtttacgaacaggcatcaaaggcatctcggataacatcgaggtccactcgatcattggtcgccttctggagcacagtcgtatatactactttagcaacgacggtgaaccacaaatttacttatccagtgcggatatgatgacccgtaacctaaatcgccgggtcgaattattgttcccactactccaacctgaaatcagtcaccgtgcgatgacaatttttgaaacaatgtgggctgacacggtcaaaacgcgcattttgcaaccagataatacgtacgcccgtgtggatgggcgcggcttagaggttttggactcccaggccgaattcattcgcgaagccgagcaagcaggtcaaggctgatcacggcgatactacgcccactagcaacgcgcaccagttcattccgatgatgagtcccaagaatgagccggatgcttcagatcttgatagagaggatgattagcgatggaaaactttgcggtcattgacttaggttccaattcatgtcgaatgacaattatacagattcaggaagacggtagttatgcggtcactcaccgactcaaggaaatggtgcgtttatccgagaatgaaaacgccacggatacgccgacccttcaagccgaggccattgaccgcacgattgcagcgctaaagtcatttgctgccgtctacaaagacttacctaacttaactgtcaaggccgtggcgaccgccgcaacgcgaaaggccagcaaccaaaagaaatttctcaaacgcgttaaaaatgatgttggcctagatatcgaagtgattcctggaacaaccgaggcctattacgattacttaggggtagtcaatacgcttccaaacgactaactgcgtcatggtcgatactggtggcggtagctgcgaactcgtccttatcgtaaacggccaagccaaggacctaatcagtctgccaatcggcgcggtcagtttatccgaaaagttcggcctcaacgaccaagttaccgctagtcaattatttaaaacgatgactttcgttgataaaatttttaatagcgtctggtggttgcgaaacggtctcaacttaccactcgtctgtttgggtggtagcaaccgaacgttagccaaaattaaccggcgcaaatgcaatatcctcaactttgaagatattcacggttatcggctacgtgacaacgccatctatgacacattcaatactgtcattagccaggatgcagctggtcgcgcggctattcctggattagcaaaggaccgggctgatattattgttggtgggatgattcccgccattagtctgatgcgctttttagattctgaccggatgattttctctcaaaatggactgcgtgaaggcatcctattcgagcacctgactgctttagctgaacaaagcgctaaagtcagcgaataaaaaaatcggactgacatttttatcagtagtatgctaggattaaaacattaataaattcatcaaggtcgtctttgatgcttgtatatctttacaacggaatctccgttggtcaagaaaagcgtcgtttcacatacgaaacgagctggccttgatcaatggaggttttattttgtctacaacaacacctgtcatcccaacccaaacgaaggttgcaatttttggcaccgccagtctggctttttgcggtattttagttgaaacatcaatgaacgttacctttccgaccttgatgcaccaattccacaccactctagcaacggttcaatgggtcaccactgcctatttactcgccgtagccgctaccatggttattacggcgtttattcaacaacgcttccgttggcggacaattattaacgttggcgggtgggctggtttcgttcttggcggtttattatgtacagtcgcgccacagctctggttactactattcggtcgaatcattcaagccatcggaactggattggcattaccattagtatttgcgcaaatcatgaccctggtccctttcactgctcagggtcgttttacggggaccgctggaatgttgatcgcattggccccttcactcggaccaacatatggcggcttagtgacacaactattatcctggcgcttaattttcggcattaccctaccgtttggtctgattgcttggctgataacggccaaaactattcgccaaacggcaccacggtcacgtccgttccccttatgccaattcgggctagtcgtcgcggcactcatcccgctgatttttagcgtcaataaccttagtacacatggcttaagcttagtattcgtctggttaccactgttattagcggtactcgccgtactgacttttacccgttcggcaacccgaaccacgcgcacccactaatcaacctggccgtcttccaacagggtgactttacccgggcgcttctcatttacttcttcattcaattcattcagattggactgacctttctgctccctaattttgcacaactcgctttgggtaaaaatgcgttagtgtcgggcttaatgctattagcaggaagcttatgttcagcaatactatcacctttggctggtaaattgatggaccgtcgcggcattcggcgaccattccaaattggtagtggctttttactgttggcaacactaagtctcgcgtggttagcccagcatctctcggtcggcttgatcattggcttatttgttggctttcaaattgggttcagttgcttatttaacaatgccctgacgtatggtttacaacaattgccgccccaactaatgggcgatggcaacgcgcttttcaacaccctacaacagtattctggttcgctcggtaccgccattatggccgtcttgattacattggggcacccgcatggcaccgagtgcttcgagtacgatgcaaaccaccctcggcacccagatcgcactctggttcagtctaattatcattatgattgtagctgctttagcgctgactacgaaaccaattgcgaatatggctgacgaccaacatcaatcacggtcatctaaccactgatttacttgggatttggttaagccgttaaaggcttcattaagcttcacgtcttctttacttctgaccactgagtttacggtaagatacagttaatccaaaccgaggagtggtgtgcatgcgttgggaaccgttcagaattattttaatagttgcaacactaagttgtttggtgattcttgtccacgttcgccagccacaagcccggacgcggcagctactcggcttaggttacttatttggccttagtgtgattttgtttaccccgctgtcattcgacggaactgccatctacgtgatgccagctggtgtcggccaagtgaaccctatcacggttgtatcttcacgggctgggctttatcgaaaatatcattctgacgattcccttaggctggggaattaaacgccactttcatcactacccactattgggcctcggattaacgggcttgttagtgggtgccagcattgaaagtctgcaatatttcatgtcacaacattggctgatcaatcgcagtagcgatatcaacgacgtcattgccaacgcaacgggtatcctgattggcggactcgtggcagctaccttccaatttgtggcccagcaccgcaagacaagcgtcacggattactgatcacaactgtatcctgaagcttgcaccccttgctggcagcttaatgctcgactgcgccgtaaatcacggcatggcgctcaacttaaattcacaaacgcagtgacaaaaagacggttgttagaccaataatagtctaacaaccgtcttttgtggcgtcttctcaattttaatggttagttgtggacttgtcctcatgcgcggcacgttgcgcttgctgatcttgatgccagctagttggactccataattggccttccattgaaccccgtagactctcaatctcagcctgttggtcatcgatgaccttaatgatactctccacaacaacttgattatcagccgtcttcaaagcggcgagtgcctggatcgcccaggcagcctggtcttgttcactcattatgttaaaatctccgtttcctttaagcctttttacattgtacacaaaccaactgattataccaaggaatctgcttactcagcaaaggtaacgggcggtaatcggcaagtaaaataacgccctacactgcgatacgctgttaagaagacacgcaacctaacgcgccctggtggctggctgatattgttctttcgacaaaaaaacgccccatcaagaatatcaacacaattcttgatgggccgctttcgtctcaaacgctaaatccgattaaccaactgcttgttgatcatcgtcataaaaagtttttgttgaatttcacgtaattcagacttacgtaccgaacgtggcaaaaatgcccgaatgtcctcttcgttataaccgatttgtaaccgccgaccatcataaatgattggccgcttgagtaattgtggtttttcaactaataggtccaataactgattgaagcctaagtccgacaaatcaatgtgtaatgctttgaaagccttagaacgcgttgaaacgatgtcctcgaagccattttcagtgagccggaggatttgtttcaattcatcgcgatccagaggattagcaataatgtcgcgttcattaaatggaatgttattctcaactaaccatgctcgtgcactacgactagacttgctggacgttgaataatataagtttactgtcacgatgaattcctcctaagtttcagcaagtgactttacaccacttactttaatatagtaagtatacggttttagtcaagaatagtcaaggtttgtcagaactttttagttaattatttctaaagttctgccagccaattacccatcaaatgccagcgctattctgtacttgtgccgacaaaagcggtacctcacgagataccgctacttaactaaacatgaccaactgcccgggctgggatcgaaccagcgacctcttgattaacagtcaattattctaccgctgaactaccgggcaatgactatgtctgtatttatacacgcttttatgataaaaaacaagtcctttttaaaaaaagtcacactaaattcacataattaatatgatatccgcctcaaacaacgtacaaacctaaccacgataccacggaaaagtcctgttttgaaaagcgttgtgccagtgtattagtgatttctaattcactcaatgttgtttttaactcatagtagtaatccccacgctgattatgcagtgccagttgccagttgcctaaatcatcccagcaagtcgtatcgggagcggcctgttgatgcttaaacaacacgtgaaaaagtcggcttccacgtctcgtgatcgtctcctgtgatacggatcaagcgacacacttcccggtgacaacgaatcgctgtccgaacaccaacgataataccgccaccatcaccccagcaccaagtgccaacccaagtaataacaaccgggttaatagtggcgttgcttgcaattgcgagctaatcacaatcgtcgcactcatcatgagccagactaccaacacccagccattgagccagttcaaggcgacatcgcgagcatgtcgatacactgctaagcggtattgttgatcattgttgaccactcgttgtttaggggccacagttgaataaaccaccgtcatatcatcatgaaacgtataactagtaagtggttggaagaccgtcgtcatagcttgtaacgtcgtctgtggcatgtattcggcaatcaactgacgtgcttgtgagacttctttaaactgataactcagaccgtgaatcgccgtcaattgatagccccgcgcgcccaccgcccgccgattgagccaagcaacctcggcagcagagcctttaagaaaaaaagcgtcgtttttgcatactaggaatcctccatttcacaccgatttgagtccccattatatgccgattggtctacatttcaaatattcattaatcttagttcaacaccgttactaaccgttgtacaaaagtaatattatcaaaacaagcatggtaaccctttcttcattccagcggattggtatgggtgtgatgattaattctagatacttcgtgggacgccagtttatatattaagtttttgatatttattcacaaatccactcatccatgctagcatcaaagatgatgttattgattacaatcttcggaggaacaagttatgtcagccaaatatatcatggccattgacgaggggaccacgagtacccgcaccattatttttaatcacgccggtcaaaaagttgccgacgcccaaaaggagtttccacaatactttccgcaaccgggaggtgggtcgaacacgacgctactgaaatctggaacgcggtttcctcaacgatcgctaacgtcttaattgacgctaatattaaacctaatcaaatcgaagccatcgggatcaccaatcaacgtgagactaccgttgtctgggacaagcaaaccggtctacccatttataacgccattgtttggcagtcccggcaaactgcaccgttagctgagcaactcatcgctgatggtatgggcgatctgattcaccggcacaccggcctagtgaccgacgcctacttctcagcaacgaaaattcgctggatcttagaccacgttgatggtgcccaaaagcgcgcggaacgcggcgaacttcttttcgggactattgatacttggctcgtctggaaattgactggtggcgagacccacgtcaccgactacaccaacgccagtcgcaccatgttattcaacattcacgacttacaatgggaccaaacgattctgaacctactgaacattttctgctgcgatgctcccagaagtacggtccaactctgagatctatggcacgactagggactacttgctttatggtagccaaattccaatcagcgggatggccggcgaccaacaagccgcactatttggtcagatggcctttgaacctggcatggtcaaaaatacttatggaaccggtgcctttaccgtcatgaatctgggcgagcaaccgcaattatccgaccacaaccttttaacgaccatcgcttacgggcttgatggcaacatcaattacgcgcttgaaggctccatcttcgtagcgggttcggccccgcaatggttacgcgatggcatgcaactgatcgaatcagcaccagaatccgaaagtcttgctcaacagtcccataatcacaacgaagtttacgtagttcccgcctttaccggattgggcgcaccttactgggattccgagacccgtggagccgtctttggcttaacccgcgggaccacccgggctgatttttgttaaagccacgctacagtcactggcctaccagtcccgcgacgtcattgatacgatgaaaaacgacgccaacatcaccatgcccacactcatggtcgacggcggtgcagcccgcaacaactggctgatgcaatttcaagccgacatctcaaacgtcaagatcatccgggccgctgacctcgaaacgaccgcactcggtgctgcattcttagccggcctagccgtgggatactggcaagatttggacgaactcaaatcaatccaccaaaccggcaatgtcttccaaccccgaatggccgcgccccaacgtgcgaacctttaccaaggctggcaagccgccgtcaaagcagcccaactattcaagcacatcccaatcaacgcccaatcaagtaccaactaaactaaatttctagtcaaaaacgccgcgactgaagtcagtcgcgacgtttttagttcagcactattttccttgaatccatcactgccattctcatctatccgataatccgcactgtgtttgttgcttttcatgattaaaacgtgccgattaggtggatttctgttcgtcagcaatgatcgtcctattccgacctccggggctgggtgacaattgctgtaacgtaagccgacatcgatttgagctaacgcccaacccgcgtcatctcaaatacgagtcttattctaagccggaaggaaatcacttccgactaagaataatttggctactgagcattgtcacccagtccctccagtctcaagagtgtgcggggccacgagttgaagccgagcattgcctagccaacggattaatgcggttttggcattagtccgttggcgtagcaagcacaggctttagtggcaccgaacacgtttcgggaagccgctcgaatggctgatgaacggccacttaacttagcacaatttatcgttgactattttgatacaggaactttaaacgagacgttagggttaccctaaccactttgttgaaacgttccgattactactatggtgattccgaaatagtaagctatcacaatgtcattttctgcctgacagttgctcgacaaaattactgtttatgaagaacaatgatgagtccaataaaagttgggtacatctccgtctgccattcgaacactgtcccgactggaaggcgtttctgacaatgcccagtggtgaaatttcacttagcaagcgtcttgtgcttggttagtgaaaggccagtatttaagacgtgggcttcggcttaaatctgtgcccaccacgttccggcaattggcagaaatgcctggaagtcggcataggacacactaactaagcaagtttacgctaacctgaactttttccagcgggtctaagctggttgcttttgaacttaaaaacttggcacgttttaatcatgattgatgacagattaatgaatatcgcgtggggtttatgataattgtagttcgtctacttttttgaaggcgtgactggctagaaatagcagggataatatgccggcataaaagagggcaaatagtaataagaatagccgtaaatcaaagcggtcagctaggaaagaaaacgctagcgaacccagcggtaaggtcacggaaaccagcgtataaaagcggtcattaccttcccgagttggtctgaaccgaccatcgcttgaatcatcggtgtctcaaatacttgcgtcagtccttgaaagacaaagctcagtaagtaaatgatggcaaacagccagaactggttgtacgacactactgtcaagatcatgaataacgcgcgcccaaagttgccgatgaggtaagactgccgaacggtcaactttttaactgtcagtagactaccgtcatccctaataatattccaacggctgacatcgactccaaaataccgtagtagatcgagtcaccgaaatgccgcccaaataaaacgacgtacgtattcaaaccgccaaagaagaaattcatgacggcgctcgcaaacgtcaataaacgcagcagcggatcagtgctgataattttgaaaccaaccaaaatctggttgagatacaaggacttttccgcatgtgttgctgacggggttcagcgagtttgatccgcctaaaagtggcaacggtaacgacaaacgtggctgcatccatgattaaaacaccgagcactgagcagaggctgatcaaaaatccagacagcgcgttgaacacgtaatccgtttccttgtaggcaattgacatgtccgcttgtgcttgaactagctggtctggctcaacgagcagcggtactaatgtatcttgaatcggataagctagtgatccaaaaagggccgcgacgaataccagcccgacatagatacctggcaacttaatatgtaacgcaactaatccaattagcatgaccacgatcactaactgtgaaaattcaaccgcgactaataatcggcgtttagaatgtcggtcgatactgtcaccaaacagaaacaacaacacgcccggtaaaacaatagccacattcatgatgccgatccacaacgcactgttggtcaattggagaatgaaccagttcatggcaatcatgtagatgctgtcaccagcgttacccactgctcgccctaagacgagttttctgaagttggcattgatcacattatccgcccctttcaagccttgcaacaatgttactatcacacatcagaataaggatcgactcagctttcactcgaatctgcaacgcagcccgggcctgcttagtaaacatcgtctcagaattaattatattataattagcaaaaataacaatatttaatcttattttaatgttaagattcgtcctcccaggtaccaaaaaatctcccatgtcagctaatagcgacatgggagcgttacattaacggttatttttcgttcagccattctaattattagtgttatggtaacgattattggtctaattccggcaaaaagccccgctgcctagcgattgtcaaaaactctcgccgtttggcgccgctgagtgggtcgcttctgcgtcatgtgcgctaagtgttccgtacgggcgtgactactccgatgttgataatactgattcaaaacgccatcaaaccggtccaactccgcctgataactcgcgaggctcagcataggtatcttgaaacaacacagcgggcaaccctaatcgaggtttcttttcaggaacatccgctgggtgccctaactgcaccccaaagacgggtaacgtcaagtccggcaagtgcagtgcgtcaatcaccgcacgcgtgtcgttgttaattgatccaagtacaacgctaccaagacccatgctttcagcgaccatcaccatcgccgctgtaatcagcgtggcatcttcaatactaccagcaaagcggtcaaattcactcagtgcccgacgcgtcgttgcgcccggtgctagcttgacgttgcggtgttggtccgcaaccacaactaataaacggccgttttcaccaaccgttggcatcgtcgtaaatcgtggccaattgttgccgtagtgcgaggctgagtgatctcaatcaaactgtatgcctgtaaatattggctagtcggcatttgttgtgccgttgtgatgatttgcgcgaattgcgcatcactaattggttcagtggtaaattgtcgccgcgttcgatggtcctgtaaggtttcaatcacactctttgtcacttaaaatcgctcctgttcttgttgtaattcccgtgaccagtccgttaattgtggcaacacgtccaggttcaagttaaacacaattcgttgacacacttgatcaagctgtacgctccgaaataagggataacgggtcccgccctgatcctggtgtatgataacacttaacgtaaccagctcatctaacgccttttctaacagtgtcatcgcacgctgcggaaaatattctcgctgtagtgccggcgcgtccaatgagcagcccgccaacgcttcaacatctcgccgagtcaataacaaactttccggatggttcgccaattaatcgacttaaaatctgaacagtcaattgggtctcaaacgcgttacgaaaacgaaaacgggtctggaaatgactttgaataaattgtagcaatgccccattcttcatttaataacgagcctccttaaacatgcttattgataataacactgatactagcgtttgtaagttattttccccaccacgcacccgcaattaaatcaccacaatcagtcaattacatgatccaaacaaaaagctgagcttagagaattgacattctgaaagttcaacttttgagccaacgcctactaaaaacaaccgccgtttgataaactcacactctgcgctaaaatttggctaacagcttttagccaatatgattttctttcaaaatcagatcgacctcagcttgcatgtcaggtgtttttgtccattcttcccaatgatccatcgtttcatcgggaatcgtaaatgtttcattaatatattgctcatacttggcaacatgcgtggaatgcggaatgtttagttgtaatatccgcacttgcttaataaaaccacgttcagctgctaactcagcgcggccattcatcaacatgtttccgatctccatgtatgaggtcccatcattacgtgttatttcttgaattaagtctaatacttcatggtttttcaactgcaatccctcacttcacattttagtataagcggggttggcagtcgtgtcaaaactgaccagtaattgccaggtgatcaggcttggtatgcctaatcacctgtacttgatgaacactaaactaactcagtcagccccaaaatgctaccatcagccgagcactcctttttctgagtaaacatcaatcttcaaaaattacaagagagccttatcttcatctagtccgccataaattcgctaatttcactcaaaaaaaccactatccaagcagatagtggtcggcataagagagaaagagaattgattagaaggtaattaaataccttacaaactaagaataagcgatattgtaagcgttgtcaacagctagccaaaataaatagataaattatttctatttactcattaatctttttctaacaccctcagccagccatgttcgccactaaattgccgtctttacttgcacaaagttaattaattcaccttatttaatagattggtaccattcacaattaccaagagttaaaataaacttctcaacctagataattttaattattatcaacaatcaattataattatttacactggttatttaaattgacctcactagcaactaaccctgtcactctcgcattaacacttgctgggttattattcgcattccctttaagaatgaaatatactaaaagtaggcggtaacatgtcaggcagctatgggagtgagggcattatgaaaataatcgagcatcaggggaacgggattaattattatacattagtgaacaatcatcatatgagcgtcactattatggactggggcgccatcagtcaccgcgatcaaaacccatgataaagatggtaattttgcaaatattgtcttgggatttgacgacggcgccgactacatcacctatcaatctttttcggtgcaaccatcgctcgggttgcggggatcatcaaaaatgcccggtggcggcagtatgacttaactcaaaatgcgggcgaaaatcatctaaacggtggtaatatgcctcaaatttcatttgaaccatggtttttagaacgtaaactgcacactagtgatcaagttggactcgtcatgcaatatattaccttggacggtgagaacggctatccgggacaatgacgatcacggctaatttcgtattagataacgacggtaaatttactattagctacactggtaaaagtgataaaacaaccttattcaaccccagcaaccatacctacttcaatctaagtggggatgcggaacgcctcattgaccaccatgttcttaaaatcaatgcagacgagtacgcccgcgcgttaaacaaacacggtattccaactggtaagttgccatgggtcaccgacaccccatttgattttcgtgacccagtcgaggttgggccccaggttgctaacatcaagggcgggctccatcacggcttcgtcttaaacgacaccccatatccacaagtagaattactagatcgcatcagtggacgcaaagtcacgatgcgaacgaacgctccggcagtcgtggtttccagtgcaactaattaccgtgatgatcgttatcgactcaatggcggtaaaccgatgcgttctcaacttggtctttccccgcaagcacaaaaattaccggatgctattcaccacaaggaatttggcagtatcattatcgaacctaatattcctgtaacctaccaaacggcctatcgtttttctaatatttacgacgtctaaccactcaagaatgattcaaattgacctcccagaatgcaaactactgggagcttttttgactcactaataatgcgttttacaccataccattgactgaacgaaaatctcctaacccattttagtcgacggacatggcctcattaccatttacctactaggcgcatatgctattatgcacgttgcgcgagttaatctgtcatgactcaggacgagttaactatcaaaataagtgctattatgataataatacccacatgtggcttaacgactagtacatttagtggcggtttaataatgaccaccccatcaaatgtaattaataaggaggatcagattatgccagctactgacttacgtgttcagcgcacccagactgcgctgaaagaggcttttcggacgcttgctttaaagtatccgcgctatcgtgatattactgttaaggagctcacaagtgtcgctaatatcaaccgcaaaactttctatttacatttcgattccattgacgatttagcggaaacgttcgttcaagaaggtgctgataagattctagcactcattgacccgcaagatttcaaacgaaaaacattagccaacccggcttaatctttgatcgcttagtgacctattttcgccaatctgaagcttttcaccgagtcattttgttgaatgatgattacagtttttgtctcggaaaatccacgctgccgtggtagcggggcttacaacgacgattcaaacaaactatcatttatctgcaatcgatgctaaggtctgttcaagctttttgatccacaacaatttaacctttttccggctctattttaatggtgatttaggactctctttggctgaactaaagcagcgtttagtttcgctcaacacttatggcattcatcaattcttctaccctaatcaatcactttaataggacccaaaaagctgagctatcgaataacgatgttcattcgatagctcagcttttactgactagttataggcttttaattatttaacaactcttgttcaatggttgctaataccccatcatgttcattatccagggccgtcacgtgtttttgctgcggcttgaatgtccgccggtgcgttgcacatcgcataactgtgcgctgcatatcgcaataatgggacatcattcgccccatcaccgaaggccatcacattagctgcagttaacccaagtttagtcgccaagaattgaattgctggtaattttccgacccgctgatcaaccaaatctacgacgccatacccactatcatgcgcacgtaactggccatcaaaataatcattagcccgtgccaccagatcagcagcctggtccggtgacgttgagatactgatttttttaacggtatcatcaacagtggccagatccgcaactaagtgtaaatgatcataaaactgacgggccatcgctactaacttatcaggtgctcctaactcagtatacgacccatggctaccaactaagattacgtatgcgtctttgaatagtggctggtaacgatcaacagtcacaaactttcgttgctggtctgctgaaagactaccatcaaagatcgatcaagcggtcctgggcataaatcgacgccccattttcagcaacaacgataagattatccaccataacatctttaaataactgtctaagatgggcatattggttaccggacgaaagtactagggaaacatttatcgcccgtaactgtgccaaaacccgtttaaaccgttcttcgtcaaaacgctgatcttgatgcaataatgttccattcaagtcagttgcaattaaattgattgccacaagtagccaccccatcttttatcatttactaacaaaatcggcctcgtctcgtcatgtgattcagccgattaaacatcaacatgacactcagttacattgctacgaatactattgtagcataccactattgtcatgccataaatgtcgcgggtagttgcggtttggcaaaataatatccttgccctcgcgtaatgcctagatgattagccagttgaacatcagccgctgattcaatgccttcaaaggtaaatagcatttgctgttcctccgccttatcaaaccaaaatttgagcgtcgaaacaattgcatccgtagttggggtccccagtggtcgcatattttgtaacgcgaatttaaccgtattcacatatggcaacatcattttgatctgttggaataggttatcagaaccaacatcatcaaaagcaagtaatataccagctgcccggtacccaacacttaattgctgtaactcacttagctcaggtgtcgcaactagttcaacagttagttctcgtggtaacaaatgcgtctgcacatagtgactaattgcagcttgaaagtcaggattagcaaactgacgcgccgttaaattgatggaaacatgatggttatttaattcctgaatagcgcaatccagcaattgaatcaattctgttggcgctatttcaaaggtcgctggtattcgccaagtttgttgcctctcatcccactgtcgtaataataactcatacaagattgttcggttggttccaaggtctatattaattggctgtgcaaaatatttatatttcagcatgaccattcatccccaatagtctaattatttagttgtgttatcgcaaccgcttactttatcataccaaaagattgtcaactttcacaatagtcttatgaatattagtagttaaaaattatacaaaagctttgtgggcaatcaaaaaacgccaccgtaatcgaacggtgacgtttcttggtgcccacacacttactttaaattattcaacggtcacactcttggcaaggttccgtggtttgtccacatctaagcccttgtttaagctcgtgtagtaggccaataactgaccaggaacaacactaagcaaagccgttaatcgttcatcaaccgttggcaagataaccgtgtcaccatctttagctaaactatcggtgacgatagtaactgtcttagctccccgtgcagcaacttcttgtaagttggagcgggtcaacccagcggtattcttttgcgtaataatcccaaaatcactggggtatccttttcaatcaaagcaatcgtaccgtgctttaattcaccagatgcgaaaccttcagcttgaacgtaagagatttccttgagtttcaaggccgtttctaatgagacggcgtaatccagtccccgaccaatataaaatgcgtttggcgtattcaataaggcactcttagcaatcttttcaaaagtagccttttcatcaactaagctttgcatcccattagcgactaacgccaactgctgtttcacgtcgaaagctgttgcagctggttggtcaacggccacacctaacgctttagccaagatggcttgtaaggcaatctgtgcggtataggctttggttgaagcaaccgcaatttctgggccggcatgcaataacaacgtgtacgttgcttcgcgtgatagcgttgagtttggcacgttcgtgatggtcaagcttgggaaatgttgatcgttcacattcaataacacttcacgactatcagcagtttgcacaccagactgggtcaagaagatgaagaatggatgtgctgataataatggttggttgtatgcaaattctgacgaaacgtgcacttcagttggcacgttagccaacgattcaaataactttgcaccaaccagaccagcatgataactagtcccagcagccacaatgtatagtcgatcggctgctttaagagctgttaacaagtcatcattgatgattggatcacccgcatcattaagataaacttgggatagcttccgcatcacattcggttgttcatcgatttcttttaacatgtagaatggataagttcccttgtcagcttgagctgcgtcaatgtcgacatggaatggcttccgttcaactggttcaccggcctggttcgtgattttaatttcatcaggtttaacgaccacgatttcgccatcatgtaattccaagaaatctttcgtttggtctaacatcgctaaactatctgagcagaccacgttaaagccttcgccgaccccaattaataatggactcttattctttgcgacgtataaggtgtcaggatcttccttatccatcagtaagaatccatatgaagaatggccgagcagacctaacgtcttacggaaagcggccaacgtactcaggccttccttggtgacaaaccgatcgactaattgaacaatgacttccgtatctgtttgagacttaaaagtcacgtcacttaaataagtctgttttaagtcttcaaagttttcgatcacaccattgtgaactaagtagaagcggccatccgcagaaacttgaggatgcgcattggcaacactcggttcaccgtgagtcgcccagcgagtatgcccaatcccggtcgaaccatgaacagcttcgcctacttctttacgtaagtcatcgatccgacccttttccttaactaaatagtcatgaccatcttgatcattgacatagataccagctgaatcatagcctcggtattccaacttttccaaaactccgttcaataagattgatactgcactatctttacccgttacaccaacaattccacacataaattaatcttcctttactgtttgaattgtttctagctgcgtagtcaatatatctgtcaccaacctcacagtcggtttttgtaattgacctgtagagtgcagtccctgacgtcacccgtcgattatcgataaacgtcatcctcgtcaactttagattctaaagtcctggcgctattccgctttaaccaattaacaattggtctagtctaacctccgattggtatatttcctagaaacaagttaactttaccgttacatctaataaaagtcaacaatatattatattggtatacgtgttagttagcgtgtataccaatctcaaacgcttataaatcaagggcatcacgaattttcgaattttttgtaactttttgcggtcaaattggtttgggaggcactgggtctcctgacagtcgccagttaaccgcgttgccaaccgcgccaaccgcatttagcaatgaccgtgcgtttcatggcaacaaaaaagtcgcaactctaagagtaacgactttttttgatgatcggtctgatcacttaattattcaacgccaacttcagctttgaccacatcgacgatccgatctacataagcgctaaccagttcgtcggtcttcgcttctgccatgacccgcaataaatcttgggttccagaaggccgtaccaagacgcgaccatcaccggccatttcatcttcaacgtccttgataactgccttgatcttatcattgttcaaagcggctttcttgtcttgaaccttaacattcactaacttttgtgggtaagtcgtcacttcggcggctaattcagaaagcttcttacccgtttccttcatgacgtgcaataactgaattccagtcaacatgccatcacccgtcgtattaaagtctaagaagaccacgtgaccagattgttcaccaccaaggttatagccgtccttcaacatctcttcgacaacgtagcggtcaccaacttgggtctgcttgctgtgcaaaccagctgcttctaaggccttgtataagcccaggttactcatgaccgttgtgacgaccgtatcctgcttcaacttgcctcgttcactgaggaattttccacagatgtacataatcttgtcaccgtcaataatgtttccaagttcatcgactgcgatacaacgatcaccgtccccatcaaaggctaaaccaacttgagcgcctttttcaacgacgaatttagataatgcttcgggatgtgttgaaccgacccctttgttgatgttcaagccatctggtgccgtagccatcgtatcaaattccacgttcaaatccgcaaagatccgggaaactaagttactggtagaaccattggcaccatcgacagccaaatgaatgccacttaagtcatctggaatcgtttgttccaagaattgtgaatatttaagattaccctctggaaaaatcagcaactgtccccagaccttctgctgctggccgtggtaaagtgtctttcggttgatccagtaattcttcgatttcttcttccttggcatcagacaacttgaagccgtcgccaccgaagaacttgatcccgttatcttcaactggattgtgagaagccgagatcatgacacccgcgtcagcatcttggatccgtactaagtaggccactcctggcgtcgtaattacaccgagacgtaaaacttcaattccggctgaaagcaagccggcaatcaaggcttcttccagcatttggcccgaaatccgggtatcgcgtgcaactaaaacgcgtggttgcgtactcttgttttccgcatgttccgtcaatacgtagccaccagcacgacctaaacgaaaagccatttcaggtgttacgcctgaatttgcaattccccgaacaccatcagtaccaaaatatttcattataatttacctcatttcaaaagtgtcatgattaatcatttttaactgtaatttttactttgaccgacgttgggctaactgacgagatcccatcctcatcgctagtcgaaacatcgaccgtcttagtcgtggttgaatcaacattcgtcacatcaacattgactggcaaagacttcaacttcgccaatgccgccttcgtgccagtaaccgtcactgacttcgtgtcagatgagaatgaataactggtgtccgccgcggtcttgccactggctttcaaatcgattggcacatctttcgtcgttgtcgcctgcgtaatgggaatatacaccgacgtggtcgaaggcgtcaagacaacgttcaaattttgaccgttggcatctaatgcttcaatgatagcctgctggttcacggatttctctaaattcttgttggtattaacgaccgcaacgactttcgcgactttgctaacttcgctgacggcgcccgtaactttgacagatgatgttccgagccgtgccgatccaacttcataaccatctgctacgttggctttattgaaatctgcgctgaccttataagtagccgttcgtcgtggttgaatattaacatgaatgtacttttgactaagtccataactcaattctttattcaagccatcgacttcgactttgacactgtgccgcccaactgccaacttagataaattagcataaactttaaaattctgcgtgttagccgtagttgtgactaaagcagacggcccttcgatcgtaactttaatattttcgggatagcccgttacaaaatatttcgtactattcacgttcagttctaagggcgcgctaatggtcactttacggttagatgtcaatgtcgttttcgatgaactattcgtcaaaatactggcgttatgcgttgtctttaacgaattaacgtaggcgaagagcaccaacgcacacagcagtgctagtagccgcattgaccaattgctattcataaatttttttcattttcggggacctcctccgaaaactcgtccaaaccaattttgaagcgcgttttgcttggttgaatcctcaggcgttagtaagacttggcggaaataccgtaagtaattttcacgcgtcatcccccgcatcagctcattgtccttagtaatcgacacttcaccggtttcttccgaaatgacgatggtgagggcatccgttacctcactgattccgaccgcggcacggtgccgagttcctaactctttaggaatcagattgcttttcagataatggcaagtacgccgccgcaaccttgatttgattatcttgaataataacggcaccgtcatgtaacggcgtatttggaataaagatattaattaataattcgccggtgatatcagcatctaatgcgatcccagtctcgatataatcctcaagacccgtgtccatcttaatcgacattaaagcgccgatccgccgtttagccatatattggatggccttatccagttcggcaatcatccgctcttcatcttcattctgacgcttaccacgcgcaaacatggagccacgccctaaatgctccaatcctcgccgaatttcgggctggaatataataaccattgcaatgactgcccagttaataatttggtccataatccacgataccgtgtccagaccaatcaaaacactcacagctttaataatcgcaatgacaacgatcccgcgaaacagttgtacggctttagtgccccttagcaacacaatcagctcataaatgacaaaccataccgcaagaatgtcaaggagtcggacaaagttttgtaaggtcaacaaaccgctccaattgaaagtcattagtctcctcctcatgaaaatcatttactttcacattatagcacggcaacccggttctcgcggtgcgatttcagcagagcctgcgctttttagctagattttgaataaatattaagcttgatgttatttaatattgcttgattaatatttctgttagaattagtaccagaagggaagtgatcctaaatgactaagttacagcggtggtttgtgcgactcgcattctggggatttttcatcttcgcagcagtcgatttgcacggcgcgttccattttctattacttaattcaattttggcttatgtcccgatcgagctgagtttttggctgacaccccgacgtagcccgctattattttggctgattgcggtcatttggttgcttttctatccgaatgcaccgtacttaatgactgatttattccacctcagcctattgaagccgtatggcatcaacggtctcttgcgcttcgacttaccgatgtggcgggatttcgcttacttggttgggccaatgatggtatctacaatcattggtacctggggcgttgaccgaattgcccagcaactgacccaacgtttacacttccagcgactccccgctagtcgtggtatcatctgtgccgcactcttcctatttgctagtgtcggtgtctacgttggccgattcctccgactgcactcatccatctacttactaattacgccacagtacattgtgaaacaattagttgaaatgtggtcgctaaagatgctcgcttttgtcttgatgatgtggttacttcaactcctcatctacgcggcttggcgattcacgatgccaacggttccttatcaaacaccggataagtcctagcgtaatcaaaaacaccgtttgaactgatttgataatcggttcaaacggtgtttcttattattaactaaatattagctaattcttcgtcttaggatcactatattcggtatgccgcccccgcttatcatgcaacccactgaagccactgaaacccagttcggtagccttttgttccgcatcgttgatataacgcaacgtatcgcttgcccgtttttcaccatagacttggacccattgatgaaaacgttcctcggaagccgtggtgatttcctgttccactttatgaccagcggtgttaacgataagtacttgattcggcgatcatgcgtggaattcgtggtctgttcaatgtacttcaaatctaataacacgttgatttgacgtgcaatcgcactccgtgaaacccgctgctctttcgcaatcttgaccaacgtcagcggctcctcacttgttgcaatcatccgcataaccgtgtaggcctcaaacgttatcttatacggccgggtcggcactgaaacgaagtccccgacatattttaaaatatgcatataagtgtccacgaagcgttcatgaatttctgattctgtcataatgatgtttccccctgtaaggctgcccttattcgtccgcttaagtaatgattaatttgcaaacctaaccattcaccgtcaatactactctaacatcattataacctagaactactgatttacaatctaaaaagttaactaatcttcatcggcctcaatatcattgagcatcaataagttctccgagtaattaatgaactgccgtaactttgccgcggtgcgtaaactaatttgtccactctctaacaaatgctgtacacccgcacgttcggcaccaagactcttgatgcgtagtccatgcagctgttgttcataatcatcacgtgataacgtgtgatcatttttcgcattctcgatgcgattccggtaatgaacgatcaagtgatacagagcctggcgatcaaactgttgctcatcaacgttggcctgtttgagatactgcgacaacgctttaatagcagctttagaagcttcacgctgaatatccaacaacgccactcgtaattcttcgctatcgccaggtgctaaccatagtcgaatcccttgcattgcacgcgtcaacaacaaccgtaatgagcgcagtgtcggaagcccctgtcgatgtgtcgcctgtaagaaacgttgttcgcgccgatcgacacgccgcaagtagacctgtccagctaacttactagtttgtttattggcaatcatttctctaactgctgcccgttcaccattcagtgccactaagcgaagttccacaattcatctgtcagcatcggcgccaactcatccgcagtctgcgacgccacttctagacgccgaatctgaaactgctggtccaggatcaaatcataggccgcacgttggttagctggccgccgatgttcttcaatattttgaatcgctaactgtaagatataaatgcgggcttgcttgtatgttaactgtggtaattgcccactgctatcatcaccgtcatccgttccgtctgccaagaccgcgtcgtcttcatccggactggatccccgagtaacaaaggggagtgatttggccgccatcaatggcaaaatagccgcagcagcaactaaacttacaatgatgactccagccgcaatgaacagtacgagcgcacgttccggaaaggctttgcccgaggccaccacggttggaatcgtgaagaccccagccatcgtaatggcccccgcacacctgataaaccggacaatgctgcaattctgagactaggtttggccttctttgtgatgtcgtaaccagttgaacaacatgtaagcgtatgtccaagcaacccgaatcagtaacaaaatccccagacgattaaaacgtcaaagaccgcatgaaacgtatttgtatgcgcgcctttaatggttgcttgcgttgctgccggcaattcaataccaagaatcaggaagacgatcccattcaataagtaaacaaccacgttccagacccgttccgtcactaatcgtaattccggcgcatcttcactttcatgtgaattttgcaagtgcgataataccccggccgcaacaacggcgacaacaccggacgcgtggaaccattcttcagcaatgaaataaattgcaaacggcgtgagaatctgtaacaccacgttgaacacgatatcgttgataccctctcgtcgtaacacgtcccgaatgagttgaatgatcgtgatcagcgccagcccaacggccaaaccgaccagactaatatagaagaaatccccaacagcttcacgcgagtacaaacgtaccggtaaccgctgctgctaacgcatatttgaacccaattaacccactcgcatcattaatcaggctttcgccactgaccaagtgcaaaatttctttaggtaacttgaccccttccgagatcgactgcacggcaatcggatcagttggcgataaaatggccgccaacgcgattccaacagcgagcggaatcgttgggatcaatacgtgaatcaaaaagccaccgagaatggtggtaataaagacgaggacgattgcattcgcaaaaattgccccgcgtagttcccataattcctgttttggaaattctctgccatcgttgtacagcatgggcgcaataaagacgagcataaaccaatccgtttgcaattttacctgtacatttaataataaagccactcctagacccagcccgacttgaattaaactgaccgggattgcgactagatagtggctcaatacattcgacagcagcactaaacatgccaggtattaaaatcactaattcgataatcggcatctagtggttgccccctttgttaaattgacataactaaccttgaacgacgtcttcaccaatgattcggacttccgtctgaagatggacgccaaaccgctcaaatacaactttctggacgtagtgaatcatatccatataatcggtcgctgtagcgtgatcgacattgataataaaacccgcgtgtttcttagaaacttcagcaccaccgattcgatggccttgtaagccagcatcatgaatcagtttaccagtaaaatacccagttggtcgcttaaaaacactcccgcatgatggccattccaacggttgtttggctgctcgcaacgtattcaattcgtccatccgcgcttgaatcttggtctgattacctggcttgagaccaaacgtcaccgatacgacaatatcatcatagtcctggatcgtactgtgccgatagccaaaatctaattcgtcatgatccagggttttaagctatgacccgctggcgtcaaaaccgtcaccgtttcaacaacttcactcatttcgccgccgtacgcaccagcattcatgaaaatcgcacccccgacactaccgggaatcccagctgcgaattcgagaccagtcaagctagcgccacaagcaaccttagtcgtcgcaataattgcggcaccagcttcagcaacaactttggtgccactcgcatgaatttgcttcatgcgggtgagaatgatcgttaatccacggataccaccatctttgacaatcaaattactggcattaccaatcacggttagtggtaaattttgctcattggcaaacgtaatcagagctttcgtctcgctgattgactttggaaacgcaacgtaatcggcgggaccgcctgttttagtattcgtataatgacttagtgattcatttttttaatttcgatggctggaaaagtggccaagacatctttggtcatggtgaaaagttcctttcgtgtttcgatttagattcacttacgttaataatcactttaaccgcatagcgtttttaatttaggccgacgtatcaagcaccgcagcattgaaacgctattgaaacgatataatcaggttgaaatttgtaagcctatcagttaattttagcactttttaatcacttaataaatgacggcacaccgcgtgactggtaattgcgccagttgggtcgactggattaggcccgtgcgttgttaccgccgtcagaaaagcacggatcagcggtgcaaatcctcgcttttccaatgtcggtgtccaatccggaaaagccgtcgtggtagttgttgccgtcgtcatcacggttttagtacttaaatcagtcacagacgcacgttgccccgtcgtttggactgtcacttgttccagattgaccccaccgtacatattcgtgataacttctaattgctcatgagccgtctgcaccgtcaaatagccttgcgccaacgcgccagttgccgtcgtcgtcaaccgaaccactagtgtgttcaagtggttcatctaacaagaatagccccgtatcgaccatgtggatcatcaggtcgaaaaccgccgtttcaggatcttgactacccacttcgcgaactttttcagccactaacatccgtttgtcaggcaatgccttcaattgctgattaaaaggagcaaaacgccgattaaacccacaagtcaataacaggtgccgcgccgcagccaaatcatacaaactttggaccacctgaagatcagtcgcgactggcttatcgacataaacgtgaatcccagctaataacaactgcttgatgattgctgcatgcgtgtccgtgggagtatgcacaaatacggccgccggtttaactgccattaattccttaagggtcgcatgggtgtgttgaaacccatacatcgtcgctagttgtgctcgcttttccggattacgcgtcgttagatgaaattcatactggtcttgcatcgccgccatgacgggtaaatacgccccttttgagcaatgttacctaaaccaatgaccccaatttttaacatcgatattcctccaattttatcatcaatcttcttttagctactactgattgctccgtggcacactgatttaaatcattcagcgtccaattcatgccagtgattgttagctggaaaaacgtgccatcactgaaagccaaagatacccgctcggacgcgctgaaactaggccaaccaaagacaccagcatgctttgtcaccctatcgcacatctatccgccgtgtctggctttaatcacggcgcactgattcaattgtcattaaaataaccagtggctgccgtgttacaatatgagtaaattacttgaaaggtctgaaactcacgtgaaacttatctcttggaacgttaatggactgcgtgctgctgtcaaacacggctttgtcacgacttttaatgagctcgatgccgactttttctgtgtacaagaaacgaaattacaggcgggccaaattgaactttggacttcccaggttattatcaatactggaactatgccgagcgcaagggttattcgggtacggcgatttttaccaaacacgagccgctcaatgtaacttatggtatcggtgtaccagaattcgatgacgaaggtcgcgtcatcacccttgaatatgcgaactactacgtcttgacgtgttacactcctaattcaggcggtgaattaaaacgtctcgactatcggcaacagtgggaagatgcttttctcacatatattaacagtttgagtgccaacaagccgttgatcttttgtggtgatcttaacgtggcccacgaaaacatcgacttgaagaactggcgtagcaatcaccatagtgccggcttcactgacgaagaacggaccaagtttgaccgcctccttgcagcgggctataccgacacattccggcatttctatcctgaccaaaccgacatttactcatggtggagttatcgtgggcatgcacgtgacaacaattctggttggcgaattgactactttattacgtcacagcaattagacagtcagctcctaaacgcccgcattcataatgaaatttttggttccgatcactgtccagtggaactcgatattatccttccgaaccattaacttgaaaattaacgagattctttgtacgataatcctattctttagaaacggtggtggcaactttgaactttgtcgcaatggactttgaaacggcgaacgcgaaacgcgacagtgcttgttcactggcgctaacggttgtccgtaataaccaaatcagcgatgaattttacacactcatcaaaccagagagcgattttttctggcggaacgtccaaattcatgggattcatgaagcagatgttgcagacgcgcccaagtttccagacgtttggcaacacattgaaccatttttccaacgcgaccgcctcgtaattgcgcacaacgcgccttttgatattggtgtgttacgcaatacgcttgcccactacggcatcagcgcgccggagtacctatccatggacaccgtcaagaccagtcaacggttctatccagaattgcctaatcacaagctggatacagtctgtcaagcattggatatcgacccgcagcatcatcataatgcactagatgacagcctagcttgcgccaacattttactcaccgaagcgcaagcttttggaaccgagcaactcaaacctttcgttcgcgttcagggttaaaattaaatttatgcaagtccagcaataagatgctggactttttgtttacgcatcactaccgattatcaatactcgtagacagcttatcaattccccaaccgactgggagatgagccaatcattcacaagccgtcgccggttaggcctggttcgtcaacgcttaaattccggcccatctactatcagaacctgtttgccgtcagttcagcgaatcccggatttcaaacccagattcccatatcaatagctggaacccgtttgccggtttgggtcaacgacatcatagctcgttgccgtacaattttcgaacccaagatgctggtacagcttaacggcacgcacatttcgtaactggaccgtcaacacgaggcgttccaatgagctatagttacgcgcccaatctaagacttcctcaatcaaagcagtccccagacccatgccccaaaattctttaagtaccgctacgccaacttcaccttgcgccgcactaaaatccgtactagcttgcacggtgctcacaccaatcaaccgtgaatctaatgtcgcaacgaaaataatgttggtcgttgtgccattgatacgctcaatttgcgcctgttcatccgtttcgctcaaatcctcaatgccctcatcaacagtgaaagtattactttcacgtccgagctgagcgagtagcgctaataattgtgctgcatccgcgacttcagcagccgtacatcaacaacttcttctgccatggttgtcactccttcaattgatcaaccaagtcgttgatagtgttcaccaatgggcttgaaggttattacccgctggtcatcggcatcagtgtcccggctaattgcaattcgcaagtaagtcggcggtaagaggtcggcaataaactgtgaccattccacaacactaacgccatcaccatcaaagtattcatctaagcctaaatcttccgcaccgccatcttccaagcggtaaacatccatatgatagagcggtagtcgcccctgacgatattcccggatgagcgtaaaagtcggactcttaacgttattaggaatgcccaggctttttgctaacccctttgtaaaagttgtcttaccagcacctaaatcaccatctagtaagattaaatcaccaggttgcactaattggccaagtttggccccgattgccatggttgcttccggcgacgttaccgtgattgattccatattcttccaactcctcatccaaattaactgttcttattatagaaaaaacgaaggaaactttttcaaagtacaagctctgaagtttccctcgtttaacaaactaagtgaccgtttaagctaatccttgggctgctgtaataatcgcaaccttataaacgtcttcttcactgcatccacgtgacaagtcggaaaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtcgtctcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctaccgcaccgacaattcggggttcagttccttcagggaaaacaattgtttgatctttaccagtatcaattttttgtgctaatgactcaaataaatccatgtgataaccctccaataaattaattaatgctcaagattgacgtgctctggtaactgccaattgattggctgttcgccgaaggatgttaacgcaatgttcgtttttgaaaatggtttggacccaaagaatccgcgataagctgaaagcggactcggatgaggtgcttgtagcacgacattcgtctgggtatcaatcagcttaatcttggaccgagccgccttaccccacaagataaagacaaccggcgtcgatcgttccgataaacgctgaatggcaacgtccgtaagtcgttcccagcccttaccagcgtgtgaaaaggccacaccattttgaacagtcagcacggagttcaataacaggactcccgcttggcccaactttccaagtaaccgtggttgacgggcgtacacccaacatcattttgcaattctttatagatattgactagtgatgggggcactgccacgcccggtaacactgaaaaactcagtccgtgtgcctgaccaggaccatgatacggatcctgacctaaaataacgaccttcgtgtcagcaaatggcgtccattcaaaggcctgaaaaatattatacatatctgggtgaatatttttcgttcggtattcatttttcaaaaattcgtgtaattggtggtaatacggcttctcaaactctggttttaagacgtcccaccagtccgtgtgaataaacgctttcatccttaacacctctcgttttattgtatcataaccaaaaccactaatgataataattctgtattcagacgtaaacatgttagaatgtaattattaaaacaactaaggatgtgacaacatgatttcgattatcgcctctgatatggacggaacgttactcaacaatgaaatggtcgtttccgattttaacgctaatgccatccgtcaagcacaacagcaaggcgtgcactttatcgtctccaccggccgcccgattttctgaagctcagccactactggccgctcaaggcatcacggcacccttgattacgttaaacggtgccgaagtatacgacgcttctggcaaaatgctcgacatggtgcccataaccaatagcgtggcccgcaccgtttttcacacgctaacctcacaaggttactattttgaagtcgtaggcaacgatggtatttactctaacagtaaagccaagcgaatcgaacaaattgcacatctcctaactaacctgaatccagatacaacgttcaaaattgcggtatcgctcgcgtcagcccgcttagaacttatggacatcaattacgtggacaactataacgagttattggatgatccgactaagcatgtcatgaagattatcgctttcagcgaagaagggcccgctaagctaaaaccccttagtgatgaaattctggcaaaacattcgtccctcaaaatcacatcttcatccgcatcaaatatcgaaatcaataatatttaatgcgcaaaaaggaattgcagttgagcgctatgcgaatatgctgaataccccaatgagcgatgtcatggcgattggtgataataataatgacgtctccatgctcgaattagctggcgtaagttacgctatgggtaatgccagtcccgaagtcaaacagttggcccgctatatcactgatacaaatgtcaacgatggtgtcggcaaagcaatcttagaagtgcttgccaaacaatagtttccggaaaacggaggttgaagatgcgtaaattatatttcagccgcaatagcttcgcccaaggtgcccggattgttcgcgatgcgcacaaccaatctcactatctcttagttggtcggtgggggcggcgccaagacgcgctcagtttatacgcgatccaaggtgagctacttgccgaaattcgacaaacaaccctcggattgttgccaaaattcgatttatactataaccgtcaaaacgtcggttctattagtaaaacgctgggcttctggcatgaaatgctctatgttcgcaagcttcgctggattatcatgggaagcttgagtgccgaaaactaccgcgtttatcatggtactgaattaatcatgacgatgcgaccagttgtcaccactaacggtgaagcatttgaattagcaattactgatcaatccacagaaccactgtgtatttgcattgcggcgatcctggatcactggcaaaagccgaccaaccgcgcgcggacaccaattgcgaaaaagggactcaatgttagctttggtgaaagtaattatacattgacaccccgtaataaggtgccccaacactaaatagaactagccataaaacaacggccacccctgtttcgggatgaccgttgtttttagttaagttggcataactagtttgccagcttaacaccctatcaaagttgacgtgccgatcaagttgcccatatcacggtattcactagttaatcgtcctcagagcaacaccgcttcattctgctatgcaagcacgttactacagaataggcgcgccaagaattaaaccaattcttagcgcgcctatttgacgggttattttattatgaccagccgatacttaaacgttgatcactttttgtaagaaatcttgtaaccggggactttgtgggtgttcgaatacatcctcaggcttccccgtttcttgaatcaacccatccgccataaagacgacccggtcggccacttccttggcaaagcccatttcgtgcgtgaccacaatcatcgtcataccatctgcggctaatttcttcataacatccaacacatccccgaccatttcgggatccagtgctgaagttggttcatcaaacaacatgattttcggatgcatggctagcgctcgagcgatggccacccgctgcttttgcccaccagacaaggacttaggcatggcatccgccttatcggacaagccgaccgtggcaagtaagtcacgcgccgttttctcagcttcctgttgactttcctttttgagttgagtcggtgctaaggtaatattttgtaacactgataggtgtggaaataagttaaagtgttggaacaccatcccaatattttcacggaccaaattaatgttagtccccttgtcagaaagatcgtaaccgctaatgacaacttgcccttgtgttggaacttccaagtcatttaagcagcgtaaaaacgtactcttaccagaaccagatggtccaatcatgcagactacttcgttatcttgaacttcaaggtttaaccctttcaagacttcgttatcgccgtagcttttatgcaaatctttgacaattactttcgccatgcttagttaatcctcctttgaacccagttagataaccatgttaataacgtaatgataatcagataaataatcgcaatcattaaccaaatcttaaagccttcgaagttccgggcaataatcaacgtcccagtttgggttaattcaacgatcccaataacggatagggaattgacgtatccttcagcgtgataataaattggttaatgaacgacggaatcatgattcgaattccttggggcataataaccttgcgcatagccgtccagtatggcaacccgagtgaacgggccgcctccatttgaccatcgtcgaccgcggcaaagcccccttaacaaaggctccggtataggccccttcgttaagcatcaacgtaatcatcccagcaacgaacgcgggaatcttaaagccgtgcccaatcaggtctgggaacccaatgtaaataaagaaggccaacaccatcaatggcatcccacggaaaatataaataatcgtactggagatggccggaccaagtttacccggcataacgcctaagaccccaagaatcagtccgaggatcgtcgctaaaataattgaaataaccgttaattccaaggtcatccataaccctgagccaatcgtatccaagttttgggtgaacaagccaataaaggtccgactgcttgtgcgtcttcacccgttaaggatgcttcactagacttcaagtacttgttaatgatctttttgtaagtaccatccgctttaatcgctttgagacccgcgttaaatttctttaacagttccgcgtttttacctttttaactgcgaaaccatagtcgccggcctcgtgttgcttgaaacaatcttcaacgcgatgccattcttgattccgtatgacatcacgggatagtcttcaaaacaagcagccgagttgccgaccttaacatcgttatacatgttattcgagtcattgaaatacttgattttgaagccgtacttgctctgaatcgacttcgcataggttgcaccagctgtccccgttttaagggccacggtcttacctttcaaatctttaaacgttttgaccttgctatctttagccacagccatgaccaccccggaagtatagtaagcgtctgaaaaatcaaacgtctgcttccgttcagccgtaatattcattccggcaatttttaccccatcaacttggttcgcactaagctgctgaacagcggcaccgaaactaagcgcttttaatttataattgaaattttctttttggcaattgccttcaaaatatcgatatcaattcccttatacttaccacccttgacctgaaattcgaacggcgcaaaggttgtatccgtcgcaatcgtatacgtcttagcctgggcctgggtaccaatcgcaaaccagcttcccaacgctgctaacaacatgacaactgcaacttgccactttctcatcgacgagacctcctcaaatagtttaccggaacggtatgtcataaaatataacataattcatgtctcgcgaccaattcaatttttataattttttaatttagctttaatgatgtcgctatcatcagctgtttacttaataaaataaagtaaatagtcatttctagcaaagattctgatgaaagtaccccctttttatgttttaaaattttgttcaagcattaatcacctgcttaactgaatacttgacactagattcatcaacccgcgcaaccagccattaagtccaaacagcagcagttaacaaaacggaccaattcaaaatgaatcggtccgttgcaagaaatcgctatcaattttagctaatcgatgaacttaacacgccaatcgtacgcttaatcctcatgcgtatgccgccgacgtcctaatcccattaaccctaataatcccgttaatccgagtactaccgcgccttgttgtgctgagcggtcgcgctcgcccgtctgtggcagtgtgtcagcagtcgtgtcagttactcgtgtcacaggtgtcgctgctgctttggctgcgctagtatgctcattgttggccggtagagctggctcagcggtcgtcttgaccttagtctgtgcacgagtagccgcggccggttgttgctttgtcgtaatccgatcatcaacgccccagtcgacggtatgaccatccgaatcgttaggtcgctcactcgacttttcggtgtttcactaggatcagcgataccgcatgatcattgccgtcagggttagatgtttcgccgtgatcattgttgtcaggtacggtcgttccaccatgatcattgttgtcagggtcggtcgtgttaatgtgatcatcttccggcaagacaacggtcaccacagccgttttagttaactgattaccggcaacatcagtatagtggtaagtcaacgtgtactggccagcgcgttgcgtgttgaccgtaccatcgaccgcgatatcggctaatgtcagtgcttggccctgggcatcggttgcacgttcaaaattatcctgagcagtccaagcgtttccaacggtcaactgactatcacgcacttgtagctgggcctgactagccaatacattgatgctcgtcgtgacagtaatcagattacccacacggtccatgtaacttagtgtcagtgggtaattgctggcccgccgtaagttcaaggtaccatctacagtcacccgcgctggcgctgcgccgctgtcagcaacgtgccatccgctgccaaactcgttgaccagtcaacactatcattcagtgaccaggtcgtcttagggccggcaatcacggtaactggccgcgtactgattttagcacgcgtggcaacggttgtcacttggaccaacgccgtttgttgttgtcccagcgagtccgtgtaaaccagttgcacagtttgtggctgcccaatatgggcaaccgttaagtctggcatcgccacgactgtaatagcggcattattgaccgcaatcggctggcccataccatcagtaatcgttccaataccctgatgataatcccacttggcagtcggacccgcgatgaccgtttgtggctgagtcgttaatgctgcttggtcgactgtcaccgtcgtagtcgcagtttttacgttgcccacctcatcagtatatgtcagggtgacttgttgtttcccagcctgttgagcattgatggtcgtcatcgtaacactttgataattttgactagtctggccccaggcgtccgttaaaccagtgactagatccgcaaccgttaattttccgacaactgcgggccagatcacctgatcagcactagtcgtcatgtgcgcccgtgaggcgactgttgtgacctccgccgtggtggtttgggtcaatcctaattcatcagtgtaactgaacgtaacgacttgaggccgccccaccatggctgtactcaagtccgggcctgtcaagactttaagattggcatcaccgacattaatcacttcaccggcagcattcgtcacggttttaaagttcgtctgataatcccaatgggcagtcggcccggcaaccggtcgagcggtttgggtcgttaaggcggcttgatcaaccgtcacttgggcagttgttgtcacctcgttgccgtaatcatcggtatacgttagagtcaccgtttgggcaccaggctggctggcatcgaccgcactcatcttgacattggtcaaagacaacacttgagtgccatccgcgccggtaatcgtttgcaaaaagttggctggcgtcagtagccccgcatctttggcccatacaatctgtgccggacgtggcacgagtgccgcctgtgatgccgttaaggtcaaagtagctgacacagtatgtgtctgttgtagatcatctgtgtacatcaaggtaaccgtttgcggcttatcgatcattttagccgttagttgcgggccggttatgaccgtaatcttagcttgatcaggattaaactggtggccttgcgaatccgtaacagtcgccaattgttgccgataatcccaagtcatacttggcccccagatttgagtccggttctgactatcaatcttggcctgatcaaccgttacttttacaacggtacttacttcgttaccagccgcatccgtataagttaatgagacgggttgaacacctggccaggtcgcgtctagcttagacatccgaacgatttgataatcagtccacctgttgtccagaggcgtccgttaagctcgttacaaggtcattagccgttagcttcgccgcggcatccggttgcacgataactgccgccttggccgttaacatagcttgtgaggcctcagctgtcaccattgccgtgaccgactgggatttcccgagctcatccgtataaatcagtgtgatcagctgttgttgcccgactgaatcaacattcagatctggcctgttcaacactttaattgtccccggttggacggtaataagttgcccagctgcattcgtcaactgactaataccggcttcgtaactccacgttgccgtcgggccggcaattaccgtacttggttttgtcactagctttgcctggtcgactgtcacattggcatacgcgacggattgattacccgcaacatccgtgtaagtcaacgtcaaacgttgctgccccgctaacttggaatccagcacactcattttgacattgtcgcgatttgtaatcagaatgaccttcagcatcgtataaacgatcaactaagtccgttgccgtcagttgtttagcttgatcaggccaaataatctggtcagcaacagccgtgatcttcgcctttgaaagcgtcgtcgttacaatcacgtcggtcgtgtgaattttacccagactgtcagtataggtcaacgtaaccgtctgtggcttgccagcctttgccggagttaaatcaggcgtagtagctgtaatgtcagcagtatcgacatcaattgtctttccgttggcatcgatgacttgagtgacgctgtcccggtaatcccaagtcgccgttgggccggcaattgggtgtgtcgcttgaccagtgattgtggccaaatccacggtgacagtcgtctgagcagtcgtctgattgccatacgcatccgtatacgtcagtgtcacggtttgcggcccgatagctttaggatcaaaaccactcatcgtcacatcatcaaaattatgaatttgaacgccatccgcatcgtacagtgccgacactagtgacgacgcagtaaccatgttcgcgttttccgctaaaattacttgcttggaaacggcagtaatggccgcttttgaagccgtggcttcaacattggcagtctctgtgtgcacttgccctacatcatcagtatattcaagtacaattttataagttccagccacacttaaatctggatgttgaacgaccgtaatcttagcattgcttaatgttagcgattgtcccttagaatcagtgacggctttgatgttatcagcatagttccaagtcgccttagatcccgccacttgagtgtgattttgaagcgttagcgttgcgaaatccacggttacagtcgtcgaaacagtcgtttgattgccatacgcgtccgtatacgctaacgttactgtttgtggtccgataactttagcattaaagccactcatcgtcacatcatcaaaattataaatttgaacgccatccgcatcgtacagtgtcgacacactagtgacgacgcagttaccatggtcgctttttctgccaaaatcacccgcttagaaacggcagtaatggccgcttttgaagccgtcacttcaacatcggcagtctctgtgtgcgcttgccctaaatcatcagtatattcaagtacaattttataagttccagccacacttaaatctggacgttgcacgaccgtaatcttggcatcgcttaatgttagcgactggcccttagaatcagtgatggctttgatgttatcagcataattccaagtcgccttaggtcccgccacttgagtgtgattctgaagcgttagcgttgcggaatccacggttacagtcgtcgaatcagttgtttggttaccatacgcatccgaatacgtcagtgtcacggtttgtggcccgatagctttagcatcaaaaccactcatcgtcacaccatcaaaattcgtgattttgtttcccgccgcatcaattaactcgctgaccaggtcagttgccgtcagctttttggcttcatcaggtatgataatctggtcagcaacagccgtgattttcgcctttgaaagcgtcgtcgttacaatcacgtcggtcgtgtgaactttacccagactgtcagtataggtcaacgtaaccgtctgaggcttgcccacctttgccggagttaaatccggcgtcgtggctgtaatgtcagcatcgccgacatcaattatctttccgttggcatcgataacttgagtgacgctgtcacggtaatcccaagtcgcggttggaccggcaattgggtgtgtcgcttgaccagtgattgtggcgaaatccacggtgactgtcgtcgaatcagtcgtttggttaccatacgcatccgaatacgtcagtgtcacggtttgtggcccgatagctttagcatcaaaaccactcatcgtcacatcgtcaaaattcgtggctttatttcccgccgcatcaattaactcactgaccaggtcggttgccgtcagcttttttttggcttcatcaggtatgatgatctggtcgctgacagccgtaatcttcgccttcgaagccaccgtgttgacaaccgcagtgactaagtgttctttgcccaactcatccgtataactgagtgtcaccgtttggtcatggccgaccatcgcaacacttaaatcaggttcagtaacgactttaatatcagcggttgcgagattatcaagcaactttccatttgcatccttgacccattccaaaccagctagatagtcccatttagctttaggccccgcaattggattcgttagcttggtcttcaaatctgattggtcaaccgttactttggcataagctgtcactagattgccagcttcatccgtataagtaatagtaacggtctgcgcgccacccttgctcgtgtcaattgaactcattgtgacatctgttaggttggtactagtatcgacggggttcccgttggcagccgtgattgtcaccaaatcggcgacttttaaatttgagcaacctcactgggccaaatcgttaacggcgccttggttgtaacttgtgcctgagaagcaacgactgttacttgagttgggacgctgatgacattgcccaacgcatccgtatacgtgagtgtgacagtttgcgacccaatttgcgttaaatcaggttgctgatcaaccacaatgttaagtccatctaaactaaccgggttcccatcaaaatcagtgacactcgtgacatactggcggtagtcccaacttgagtttttgggtcctttaatgatagtactattacgcattgttaagtcggccttagttgcgaccatcgtcaccgtggtggttgtcgtgtggaccatgccagtagcatcatccgtatacgccagcgtaaccgtttgtgcgccagctttactcgtatccaagcctgtaaccgtagccgtcgcgagttcgtcagcacttagcttatcgccggccgcattgcgggagttgtccgtgtcgattaaatcattaattcgtatacgttggcttagcacccattttgatcgccaacggtttaccaactagtttgccttgatttaccgctaccgcaaccgtactagtttgctgccatactttgccatacgcatccgtatactgcaagtcaacttgataggtaccggcagtttgagtgtcgaccgtcgttacagcagtatcgccgttcacgctaatcactttgacgactgtgtcagcggtcgcataaatatcagtcccattcacatcttttagtgttgcaacactatcggcaactcgccacgtcgtcttcggcccggcaattaatccggttacattcttggacgtgaaatcagcataggatgggctagtttcccagacccaagtgattgtatcggctggattatcgacgccattatacaaagccattaactcactcgacgtatacgtctgggtggcatcagcttgattgacccatttaccggtatagccagttccagttggaatgtctggcaatgaacctaccgactaaatatgtttttgacccaaccgttaatgcgtttaggttcatgggcaacggattcccgctactatcttgattcaaaaacatatcatgatctgcgggttccttattcatatcagcttcagtgactgctgcaaagttagacatgtccaaactcgcaatgttgattgcctttaatccaggggttccctcaaacataaacttagtactagttaacgtactgcccgtctgccagcccgttatatcaagatcagtgagattggtatcatttaaaaacatcgatgacaacgctgtaacattcaacaagttccagccatgtaaatccgccgttgttaaactcttatctccattgaataacccatctatatccgtgaccatccgcacattccaagtacttagatcaatactggtcaaggccgtgttaaatgaaaacattctttttaagctcactggttgaaccgtattcaactgccactgacttaaatcataagattgaaactcgcgagtcactggcgaacatagagtcaaaggacgtaccagaactgacattccaatgcgctaatcctgagaagtcagcaatcttagttcccataaacatcattgaaaagtcagtgactttcgaagtatccagattttcaaggccatcaatactggccaaatttggattataccggaacatataactagtatcagtccccgcattaattggaccatcaatcactactttcgttaactcactgccaaaatccccggtacgtcgctgacatcacccactccggtccaatcaccagcatgaatcgtcaacacaccatcatctgtgtactgccaggcacttgttcccagagtcccagttgagacaacagttgcgggtgtggcggctcgcgctaatagtgcccgatttaactggactttatcgttagtcgtcgtaattgtattagttgtggcagttacagctatcggactagtttctgaatccacaactttttcagtttcattagagaatctttcgagtctgagtcactaatactggccattgtgctagtacttggcgatgcgacacttgaacgattagtttgtagtgattcatcagccaccaccgtgtccgtcacattagattgaatgccactctcagagcccgttccttgatcattttgataatcagaattttgtgttgtgactttctgtgaactcgatgcgacacttactgagctgtttgacgtttggtccaaactgtcgccagaaccagttttagcttgactgcttgctgatgccgaatcagaggtactaagattactggttgcgttttcattttctcctactgccgtaaccggttgttcagtctttgagtcagtagtggtgccactaaccgcctgtttttttttgagcactagtatttgttgttgccgcattaatcgccgtcgcactagactgagtcgttgcccctgttgtactagtcgtagtagtccttaaaacctgtgagttggatgatgaggatgccccagcagtggtcgtagctgcggtggctgcggtcgtcgtttccgtatctgctcgacttatcagtggattcagagtaaaggtagccacggtaataccagcaaatacccagaaacgtccctttttatacattttataatgctgcttgctcgttataaatctattcatacatgtcccccaagaatccatgcaataaatcatatcaaaattaacttattatcaatttgagttatactaaatctgattaatatcagaataataacattctccaaagtttagcatcaattatatttattgaatcaattaataaataacgcgtttaactatcaatacaattatatgctaacataattaccggctaagtcgcaagtgcttgtacccgacctttcgcaaaatatttatagcctgataactattttgctagtatctagaacatttataacagtgagcactacatcagtacatataaaatatgtgcttgccgtcgtccgtccacggcacagagaaccaccaacaacacatactaaaaaggtcttccaagaatcgaattaattcttggaagacctttttatgacgctgccatactcgttgtatggtgcagcgatgcaacgctaacgtaatcgatgcctagtaatgtttcataacccggtcgatttgacgctgttgttcgcgtttcttgatatcttgccgtttgtcgtattcccgtttcccgtgagcgactccaattaagactttcgcaaatccatgcttgagatacatcttaagtggaataatcgtcacacccttagtcatcgttgctgcacctagcttactgatttctttcttgtgcaacaaaagtttccgggaccgcaacgggtcaacgttataacggttaccctctttaaacggactaatgtgaacgttttgcatccaggcttcaccgttgcgaacttgaacgaaaccatcctttaagttgacccgccgatcgcgaacggatttgatttccgtccccgtcagcgcaatgccaagcttcataggtttcctcaacagcgtagtcatggcgtgctttccgattttgagcgagggcggtatctgggtgcttaccgtgttgtttggccattgccgcacatccccttacttaaaaattaacgccgacgatcagttgatgaccgccgattgttgttagtactatgattattattgttgctattatgattattattgttccggcgaccattgctattgccattacgatggttattgttgttgccaccacgatggtcgttattccggttattattgttcccatttcgccggtagttaccgttattgccaccacgccggttattaccacgatagttatcatgatgttccgctttggcaataaatcagtctttggcgcttcttcaggattcaataacttaaagtcgacttctcgttgatccttatcgacccgcattagttgaactttgacgggctggccgattctaaatgtccgtttcgtcttacggccaaccaacgctaatttgtttttcaacgtattcgtagtagtcgtcgtccatcgtactgatatgaactaagccttcaacggtattttctagttcaacaaacagaccgaatttcataacggaatcaacaacggcttcaaacgtctcaccaacgtgatcagccatatattcagccttcttcatcgaatcaacgtcgcgttcagtatcaatccccgccgttcatgatcagaagtcgtttccgcaatatttggtaggttatcccgataacgtgcccgggcttcttcaccagtgccgttttcagcataatggcgaatcaaacgatgaaccatcatatctggataccgccgaattggtgacgtaaagtgagtataatacggtgccgccaatccaaagtgaccaagcgactggtcagcgtatcgggctcgcttcatgctccgcagcatcataactgagaccatggcttcttcgggcttaccagcaaccttcttcaaaacgtcttgaagcatcttcggcttaacatccttagaagtccccttgacactgacaccaaagttagtgacgaattcaaagaaactaagcatccggtcactatcaggcgtttcatgtacccggtagataaacggtaccttaagttgactatagtttttgcaaccgtttcgttggctgccaacatgaaactttcgatcattcgttcagctaagccacgtacccgtaattgaatgtcaattggatgaccggcttcgtcaacgataattttagcttcgttatcatcaaaatcgatcgcaccacgatgccgccgatgcttgtacaagatacggtgtaagtcgcccatcgtatcaaacatgtcgaccaagtccgcgtacttttcacgagtcttggggtcatgggcttcgagaatctgattaacagcgtcataagtcatccgggcgtgtgaccgaatcacactttggaaaatcttatggttaacgatttcccccgtttgatcaatctccatctcacaactcatggctaatcgttcaacacatcaggatttaaggaacaaatcccgtttgatagccgccgtggcaacattggaatcacacggtcagttaagtaaactgacgtcccacgtttgaatgcttcccggtctaactcagagttctcggtgacataatggctaacatccgcaatgtgaacgcctagatggaagttcccatttggcaagcgccaagcaacaaccgcgtcatccaagtctttagattcggcgccatcaatcgttactaatggctggtccgtaatatcgacccgaccaactttttcttcatcagtcacgtaatccggaatccggttggcttcatctgtcacttcttctggaaacactgatgggacgtcgtgttggtagaccacttgtaagacgtccatcccaggatcatcaacactcccaatgacccgcttggcaatcccaatcatccgcgttggatgctgagcgtcaggataagcagccacttcagcaatgatgacttccccctcagtggggtgtaagccctgatcagtgattaataactgatatttggataatttcttatccttaatttccacagaaccaataatccgtcttcatccgtacttggtgtatacgcaccgacaatctgggtatagttccgtttaacgatgctgacaattttaccttcagggccgcggtcggaaccgggacgggctggtcgaatgatttcaaccgcaacatcgtcaccggtaatggcaaactgcgtgttgtccggattaatgtaaatatcaggcaaatcgggatcgtaacgaacgaaaccaaagcccttgtcattaccatgaaatgaaccttcaacagtcttcgtttcctggaccagcttgaaatgatcatgatcatcggtactaactaatttttacgttccatattcgcaagttcctttactagaaaagtaaacgccgttgcgcctgtaaaatgcaattcatccgttagttgttcaacactatacgtgcgatcgggatgagcttgcaaaaaagtcagggatttgttcttgtaagtttgcttctgacattatttacctcatttataaatagtttttaaatatgttaaaacatcttgttccaattggtgatgcgcactgttgacggtaatcacgtgtccagcatcagcataccaatgaaaatcaactggtacttgtggtaattgatcacgtaattgtcgcgccaccgtcgcatcaattaattcatcttgcccaccctgaccaatgaagaaaggttgggtcacagcgctgaggtgactagtaacctctgtcgtagtaaaggtattgactgcccgcaattgccgctgaaccagttccggcaacgtcattaagatctgttcacgctcggcaattgagaattgactgtgcgccagttgatggtgactcagcgtgataaacatttcagcaacgtcactacgattaccagcaaatagtggtgaactaaacgtgccaccacctagcaactgaggatcacgttccaaggccgccgtcgcaaaaaataccacctaatgataagccaaagatactaattttagtatagcctttttgccgcataaatgatattgcttgttgcgtatcttgccaccattgcgccggcgtctgtgcgagaatatctcgtggatcatcagtcgcgtgtccactgaattgggggccataaactgtataatcttcccgttctaatgctcgtgctaacattcgcacatcattggcacttcccgcataggcgtgcaataaaatgacggcatgttggccatgttcaaagaaaaacggttccggttgtttcagcatcattacaccaccttaaaaaagcctcctgaaatcacaggaggacggtcaattacttcgatgagtaccatgctagagctaacgccaggataaagaatgcgattcctaataccacggttaccttctgcatgaacgcttcaaaaccgcggggcttctgcttggcaaacaagtcatcagcaccaccggttaatgaagacatggcatcattagtttttcggatggttgcatcatcaccgcaatgataatcaaaacggaaacaaccagtattaacgttaacaataaattatacaagaaatgtgcctcctaaagcctccgctatgtctataacaatttaacatattttgccttatttttccagtatcctgaacaattcgttgctttgttcagcgctcagggcgtcgcgaccgttaaatgtgcgatttgatgacgcacccacgcacggttatcccggtcagtcaaaataattaaggtatcaccagcccgcattaaggtgtcgccatgtgggatcacttgacgctccccgcggcgaatagcaatcaataatgactctgctggccatttaaaatcacgaacttgatggccctctaacttagagccttcaaagatcggcaattctaaccgatcctggataccgctatgttccggtaaccgcggctgaattaacttctctagcaaagcctcataaatcggagcgccgcctaagagatccacgactggctgaagtaggccgtcatcgaaacgactgctaatggcatcaagtgatgtagtgtcccgaccatttcagtaatcaataaaattgcggtaaacggtgctttaccaatgccggcaaagtatccagccattgcaaaaataataaagttcggaatcaagttcgtcggcatccaaccaacggcaaccatgaactgggcatagattgcacctaagatggcgcccagtgacaagattggcaagaagatgcccccggcaaaccagaaccatatgaaatggtagaaaaggtaaatcgtaacacgaaaattcctaacaaggcgagtaacgctggcgttaccgcggccaaattcaaaataacagcattgccgcctcctaatagctgcggccacattaatccaatcggaatcaccagtaaaaatggcaccaagccatccaaccaactgggcaaccgcaacttggcataccaatttggcatcgtcagcgtcacgttttgatatagataaccgaaaataccgagaaaaatcccgagcccaatcagattgccatattgactcaacggaaggttatggccgtacggaatgtgtaatactggtacaaggccaaaaaaattgagtgaaataaaattactggccatcgcactaactaatgcggttgtccaaatgattggtgaaaaattatgataaacctcttccagaacaaataacgtactggcaatcggtgcgttgaaggccgctgaaaggccagctgctgcaccaccggcaatcaaggagcgtcgatctgatcccgtttgtttgagtttcgacgcgacaccctgaccaatcgtagctcccaattgaatcgaggggccttcgcggccgagaaacagtccagaaccaatgcccagaataccaccgacaaacttgcgccagagcactgaccaccaactataatcaagctcgccagctaattgaccctcaacttgcggaatgccagaccctttaatattcggttcattcttaactaaccaacccacaaagaacgccacagccacagacaagcctatccatggaaagagcagtagccaatttgtatgaatttgtgcgtacacccattgaacgaacctcagtccccgctcgatgctgaaacgaaaaatactaaccacgatcccagcaatcacaccgacaattaatgcccggccaatcgagctgaaccgtgtaaagtcaaaatgttgttttgcaatgtgcggccgctgtgccaccatgagttccccctcttaatcatgataatcgttgtgcaatcacttgctggacggccgctaacgtcacgggcgctccaggatgtaatgcctgaatctgctgtggtccatctacgcgtaataacaaacctaataacagatccttttctaagtcgtcagtttgataagtttccttaaatccagccaataagtcagtatcatcattaaatgcttgcaaaattagcgggactaattccgtttgttttgcagcttgatgggcggcactgaatcgctgtaaaaacctaattcaccactagtcacaattaaattctcgcccactagattgccatgaacaaattgattaggcgttacggtgtgtacttgtagccaggccgtacgctcggcaacaaagtcggggcccagtgtatcccactcggttgattgggcagcggttggcccaaatgcgggaacttcagtattaagtcgcgtcaacatcgtcccaatctggcgccccagtgttgacttagcaaggggcttagccgttgcgcaaaattcagttagcgtcagaccttgtagtggctgataaatcacgtagtagaactggtacttatcaaaaatgaagcccgcatgcaatagacgcggagcacccaagctcaatcgagccatccgggtcagtccaaaacgttccgcctgataataggcccgagtttggggataacctcactgggtggaaaaatcgcgatttgggtgggtccgaccgtaaagcgggcggccaacttatccgcaacgggttctggcgttttataaggctcattttcactggcataaattttttgaatcaccggttcaaaagcaccggcattcagttgcagtccttgccaatcagaccactcattaatttgttgctgaaagtcatccattctgctcgctccttactcaaaatacgcatgtttctattctaccacgactcgtccgtccctagaccctaaactcaaacagatgttccttaaattatgtataataaaaacgccgtcccatcggaacgacgttttcattagaacttcaaattacttgctagtaatggtgttccgtgcagcttcgtctaagttgtagaaaccgtggatacctttgtattctgaagtgctttcaagttggtcttcgatccgcattaattgattgtatttagcaatccgttcagtacggctcattgaaccagtcttgatttggccagcgttcattgcgacaactaagtcagcaatggtcgtgtcttcagtttcaccagaacggtgagaaacgatatggcagtgtagccagcttctttagccatttcgatagcttcaacagtttcagttaaagtaccaatttggttaaccttgattaagattgagttagcaacgcccatcttgataccctttgcaaggtagtccgtgttcgtaacgaataagtcgtcaccaacgatttgaactttcttaccaagcttggcagttgccatttgccagtcttcccagttgttttcatccaaaggatcttcaatagaaacgattgggtacttgtcaacaatgctgtcaagtaagtcaacgaattcttcggcagtaaatgattgaccattttcgccttcaccctttaagtcgtacttgccagtttcttcgttgtagaattctgaagcggcacagtcaaaggcaatggcaatatccttaccaggcttgtaactggcacgttcgatagcttcaactaagatttcgaatggttcttcgttgttcttcaagtcaggtgcaaaaccaccttcgtcaccaacggcagttgagtaaccgcgttcgttcaagatcgctttcaagttgtggaaagtttctgaacccatccggatagcttctttaactgaagaagcgccaacaggcatgatcatgaattcttggaagtcaacgtcgttgttggcgtgggccccaccattgataacgttcatcattggtgttggtaaaacgtgagcgttgaatccgccaaggtagttgtataaaggcatttcaagttcgtcagcagcagcacgtgcagcggcaatggaaacacctaagatagcgttagcgcctaacttagctttgttaggagtaccatctaacttgatcatagcttggtcaatggcacgttggtcagttacatcgtaaccaacaatttccttagcaattaacttgttaacattgtcaacggctttagtaacacccttgcccatgaaacggctcttgtcaccgtcacgtaattcaacggcttcatgttcaccagttgaggcacctgaaggaacgataccgccggccaaatgcgccactttcagtataaagttcaacttcaacagttgggttaccacgtgagtctaagacttcgcgagcataaatatctgtaataatagacattaatttctctccttaaaattggcttgttatttgtttcacacttattgtagaagtttgtcaatcaacttgcaataactattattagttattttgataattaacaagttccaagaatgaatcaggttgtaatgaagcaccaccgactaaaccaccgtcgatatcatctttgcccattaattcgttaacgttggctggtttaacactaccaccgtattgaatccgaactttatcagcaacttcttgtgagtaaaggtcagcaacagtcttacgaacaaccgcacaaatttcttcagcttggtcactcgtagcagtcttaccagtaccgatggcccagattggttcgtaggcaataaccaatgaacttacttggtcagctgataagtctttcaaagcagcctttggatttggcctgaaacccatgattctgcttcgccggcttcacgttgttctaatgattcgccacagcaaatgattggcttcatgccgttcttgaagatagcgtgtgcctttttgttaatgtcttcgtcagtttcgtggaaataaccgcgacgttctgaatgaccaataacaacgtaatcaacgcctaagtcagctaaggcagctggtgaagtttcaccagtaaatgccccagcatcttcaaaataagcattttcagcagcaatctttaaatcagaacccttggcagcttcaaccatttcctgtaagaaaagggctggggcagcaacgactgattcaacttttgatggatctggtaattgatccttaacagcattaacgaaagctaaagcttcgctagctgttttgttcattttccagttaccggcaataataggtgtacgcacgataaaccttcctttcggagaacagattatttttcagaaatagcagcaataccaggtaggtaattccttaccttcaaggtattcaagtgaagcaccgccaccagtagaaatgtgggttaacttgtcgccaacgccaagttgcttaacagcggcagttgagtccccaccaccaacgatggtcgttgcgtctgataaggttcctaagaacttaccaatttcaagcgtacccttggcgtagttgctcatttcgaagacacccattggtccgttccaaacaacggtcttagcgtcgcgtaaaacatcttcgaattcttcgattgacttaggaccaatatctaaggccatgtagccatcaggaattgaaccttcaacaaccttgctaggaacatcgttatcaaacttttcagcaacgattgagtcgctaggtaagactaacttgtcgccagctttttcgatgattgacttagccaattcaatcttgtctttttcaacaagtgagttaccaatgcccatgcctttagcagcatagaacgtataagtcatcccaccaccgatgatgatctttgtcagctttgctgattaagtgatcgataacaccgatcttatcagaaaccttggcaccacctaagatagcaacgaatgggtgcttaggattgtcaaccgcgtcacctaagaacttgatttccttttccattaagaaaccagcggcaacttgatccatgtttgaagcaatcccaacgttagaagcatggctccggtgagcagtcccgaaagcatcgttgacgtagacatcaccaagtgaagcccaatacttgcctaattcaggatcgttaccagattcgcgcttaacttgttcgccgttaacaacgtcttcaaaacgagtgttttcaacaactaagacgtcaccgtcgttcatgttgttgatggcagtttcaagttgttcgccttcagtaacaggtacgaaggtaacaggcttgtttaataagtttgaaagacgttctgcaacaggacgtaagcttaagcccttcttgtcgtcttcgctcttaatccgacctaaatgtgaggaataagatggctttgccatcatgttcaatcacgtatttgatcgttggtaaggcagcgacgatccggttgtcgtcaccaattttgccgtctttaattggaacattaaagtcgacacgaattaaaactttttatctttaacatctaaatctgaaacgattaatttagccaatgttaaaatcctcctagaattcgtgactgctgaaattaaaaaacggcaagaggagttttgcctcccccgccgtcaaaaccatatgcggttttaaagttcttaactatctaatcaaatattagagagtggcgaacttcaataaagtacgtaccatttggcaagtgaagccgtattcgttatcgtaccaagcaacagtcttaactaattggttgtcaccatcagaagtaacttctgtttgagtaggatcgaagattgagccgaaagtagtaccgataacatcagatgaaacgatttcgtcatcgttgtaaccaaatgattcgttaccttcagtatgcttcttgattgcggcgttaacttcgtcagcagtaactttcttgtctaagatagcaactaattcagttaatgaaccatcaacaacaccaacacgttgtgcatggccttgtaatttaccgttcaattctgggataactaagccaagagccttagcagcaccagttgaatgaggaatagtgtttacaccggcagcacgggcagcacggaagttaccaccacgtacagggccgtcaagtaacatttgagttgaagtgtaagcatggatagtagtcatagtaccaaccttgataccgaattctttgttttcaaagaatgctaatggtgcaaggcagttagtagtacatgaaccagcagaaacgatacggtcatctgcagtcaagatgtcatcgttaacgttgtaaacgatggtcttcaagtctgagccagcgggagcagaaatcaagacacgctttgcaccagcgtccaagtgagcttgtgacttagcctttgaagtgtagcgaaaaccagtacattcgagaacgaagtcaacaccgtcgttcttaacccaaggaatattttgtgcttgtggttcagcataaacacggtagttcttaccgttaacaacgattgaatcgtcggttgctgaaacgtcagcgttcaaagtaccatgagttgagtcatacttcaaaagatgagccaacaatgcgggtgaagttaaatcgttaatagcaacaacttcgatatcacttgacttttcaccaagttctaagatacgacggaatgctaaacgaccgatacgtccgaaaccattaataccaatttttacagacatactagaatttcctccttgtggaaataaaaatagttttattttaaaaagcaacttcactatagaagattacttttttaaaatcaagttagccgcaccctcatccgtgatcaaacacgtctgtttaggtgcaatgttcttcatatacgcggcaattgcggtggcttttgaagccccacccgcaatggcgagtataatctcccgatgggccagttctccgatttgcaatccaatccgtggaatccggtagaccacgttacccttcttatcaaagaagtaaccaaaggcttcaccaatcgcttcacgactgcgtaacaccttgatctgatcctcagacatattccggcgatgggccattgaaatggcttcaccgatactatgcacgaccacgttagcttgcccgataatcgccagcacctcttgaatacttggttctttgaggagtggttcatacgttcgttcactgacctgttctggtacaaacaacgagcggaacttaccgccagtatgttgtgccatttgtgacgcgatggtatttgcttgaatcgcaaccgattcaccaacaccaccacgcgccggaacaaataacaaatcacgtttatcacctaatttattagttaagtgacttgccacatgttccatggtatgcccacccataacagcaataatattacgcccttccggcaataaattgctgtaatagctggttcacttcttcgcccatggtcccaataactttcaactgtcgatcggaatcaccagaaacgatgatgcaacgcttaatattaaagtattgcgccaactgtcgttctttctggcgaatgcccattagctcatccataaaatgacttaggcctactaacacgtcctgaccttgctgggtaacttgcatgcccgatttgtttgtcataatcaaatctagcttccgcaatgtatccgtttcggtccgtaacgtccgttcgctaacacctaacgtctgagctaatagccgacgtccaactggggccatccaattaatggttcttaatactaagtaacgacgactcagcatgtcaaccatatctggggcaattgcctcaatccattgaatatctgaatgcatggcatccaacccgctctctagtgggacgggtctggtccagctatgtcgaaaagcgacccaaagacttcaaaaaacaaagcacacaacgccaaattcactaagaaatcaatgttgcatacctctcttaccacaacatgaattataacaggttcataaggtggttgcaaatgaaaccccattaaacttataaccgactggtccaaatggcgcgttaaattatcgttcggttctcaagtattgttttcgccttgatgatgacggaatattaagattttcgcgatatttcgccactgtccgccgagaaagttcgacattttccgcattaagaatctgaacaattttttggtctgaaagcggtttttctttattttcctgttcgatcaaggtcacaattcggtgttgaacactgtcggccgaaacgattttgccaccagtgggacgtttactgaccgctttggtaaagaaacgtttaagttcaaacataccgaagtccgtttgaatgtactttccattaatacttcgactgattgttgattcatgcacttttaactgttgggcaacatctcgtaacaatagtggccgtaaatcctgtcgttttttccaagaagaagtctgcttgacgctcgataatggccgttcccactcgaaaaatggttgcctcgcgttgctgcaaactgttagcaatccagtcatactcacttttcttttctttcaaatattccgtaacttcctgatcatcatgctgccccatctgctgataataccgactgcggaatttaaccaccggttgagccatggatgcggttcgcaatgccagctggcctccctgattcgtcaccactaaatcgggaaagatgtacccggtcgtctctcgcccgattgccgcaccgggtacgggtgttagtgttcgcacataatcataaatacttgaaatgtccgcaagcgtcacctgatacttcttagccaacaagtcccattgtcgattaaccagctcgtcaaaactttcttctaagacaatataggctaagttcggtgcatggtcatcattttctgtctgcaacatcagcgcttcttgcaagctccgggcccccaacacccggcggatcaagttgttgtaataaggtaattgcatccaacaactcaattggcgttgccttagtttcttgccgaacccgcctctcatcaatccgcaaataaccattcacgtcaacgtactcaattaaataaaggacaatctgacgcaaatgggtatcacgcatcgttaggtgaatctgatccaacaagtattcaaataacgaatgctgattagaggtcgacacacgctcaatgaaatccgccttagtggttacatttttggctgcgttcaaactggcgtgattattattccaatttgtatccacatcgatcaatgggttttctaatgctttttgcgttagaaaatctcttagttcttccacattaaactgcaacatctgaatggattgttgtagtcgctgggtcatcgctaacttctgtgattgccgctgttgctggcgaaatcctggtcccagtgccataaaaatacctccctgaataaatttttatgtgtaaaaacccttgtgtttttatccattattcgctagaatataatatgttgtttaggcgcccgtggtgtaatggatagcacgtaagattccggttcttgagatggggttcgattccctccgggcgcatcagtagctgagaaatgattctcagcttttttgtgcatttatttaagtgacaactactggactataccagtcacatctccatatagtaacttaatttaaaccaaacaacaagtaatatcctttcggggtcagtaatagtacctatacccgctcgtccaagtaaaaataatcaaaaagtaatcagttcaagtaaaccatataccagtgtagtcgtttagtagatttaataacagctaaacttacactattcaaataataattactacaattgttattatattatagaatcgttttaatcatggtaaatttcattcatgcatccgatactgattaattcgttgcgagcaacctgagtccagcaacaaggtcaagtcgtttaatatgtcggctcacgtgcgaatttccaacttctattagactcatcgttgtgggtcactatcagtaaattgattcacctactatcgcgataataaaattatgcgggtcgactacttttaaatcaccacattagtgctgaatatgcaagttcattactgcttaatcttgaatcattattataagagaacatcgttttcaagccaaggtagacgcaacacttaatccaaggcctactaactaaaatcgtcgaaaaaaaaaaagagattgggttcacccaatctcaagccgtattatgatagaaacctaagtataccacgttaactgcataaacggaattctgtttttgaggtttttcttttgaccttcactgaccttagcggtaaactacatttatattagcaatcagctaatcaaataatgcaaccttaggaggctaacaaatcatgtatccagttcctacagttattgaacagtcatcacgtggcgaacgtgcttatgacatctattcacgactattaaaggaccgtatcattatgttatccggtcccattgaagataacatggcaaacgccattattgcccaactactcttcttggatgcccaagattcaggtaaggacatctatctctatatcaactcaccaggtggtgtcgttactgccggcttagcaatctacgatacgatgaacttcatcaaatctgatgttcaaaccatcgttatggggatggctgcttccatggccagcgtcttagcttcatctggtactaagggcaagcgttttgctttacctaactctgaaatcttgattcaccaaccatctggtggtgctcaaggtcaacaaacggaaattgaaattgttgcggaagaaatcttgaagactcgtaaaaagatcaaccagattttagctgacaactcgggacaatccgttgaaaagttgaaccatgatactgaacgtgataactacttaagcgcacaagaggctaaagactacggttcttgatcgatgatattatggaaaacaacaaattaaaataagctaatatctttgactgggctaacttgacgttggcccagtttttttgctcgttttcttgtcattcgttttgcaatagcccatactgcacataagcggggattactacccggacaatattacttgtccttgaacttaaaagtaaaaaggagtctctataatgacaaaagtctttattgctggtcagcttccagcccaagctaatacgttacttttacaaagtcagttagtcattgatacttataccggcgataacctgatcagtcacgcggaactcatccgtcgagtcgctgatgccgactttttgattaccccactctcaactcaagtagatcaagatgtcttagaccacgccccacaccttaaactgattgctaattttggtgctggcactaataacatcgatatcgcggcagcagctaagcgccagattccagtcacgaacacgccgaacgtttcggcggtaatcgcaaccgctgaatcaacggtcggtttgattatcagcctagcgcatcgtatcgtggaaggcgatcacttaatgcgaactagcggctttaacggttgggcgccactgttctttctcggccacaacttacaaggcaagacactcggcatcttaggccttggccaaattggtcaagctgttgccaaacgattacacgcctttgacatgcccatcttatacagccaacaccaccgcttaccgattagccgtgaaacgcaacttggcgcaacctttgtctcccaggatgaacttttacagcgtgccgacatcgtcactttacacccgccgcttaccacacaaacaacgcatctaatcgataatgctgcttttagcaaaatgaagtccacggcgctcctcatcaacgccgcacgggggccaattgtcgacgagcaagcacttgtgacggcgctgcaacaacatcaaattgctggcgctgcactcgacgtctacgaacatgaacccgcaagtcacacctggtttggccacgatgaacaacgtcattttgacacctcatcttggcaacgcaacggtcgaagctcgcgatggcatggctaccattgtcgcggagaatgtgattgcgatggcccaacatcagccaatcaagtacgtggttaacgacgtaacaccagcatagaccaatcagtgtagttgtcttgcgtgacaactcaagcactgtagaaccattcgtcgaaataaataagcggtccacttcgattcgtcaagacactctgacaagtcgaaatggaccgctattttgttttgatcaagacaacgtatggacctggtgctcctactaaggtaacagctaaacgaccagttaccatgaacgtccctcaatcagttaattatttggcaatataagcatacttataattccactgtgtcccagcagtattatgaataataccctttacctttggattttgtaaataagagtataccgtctgatacaatggcgtaatgttccttgatccttcatgatcgtcttctcagcgttgatcatatcttgccaacgagcactagtatcattggcatcctggttttgagccttgttaaccaacgcattgtacgtgctgctgttatattttccgtaattataaccactattattagtcataatttgcaagtgcgagattgggtcgttgaaatcagcaccccaaccactgagataaaggtcaaaatcaccactttgagcacgacttgaagctacctttgatggaatgttggataagttgaccgtcaaaccatcgagattcttttctaatgctgatttcaagtattgtgaaatcggcttattaggttcgtcattagaagctaataactgaatggacaatttcttaattcccgtttccttaaggccttgtttccataacttttgtgccagcgttttgttatatgacgttgaattcttaaccgttgattcatctgtaaaatccttaccagttttagcgtctttaactaaatcctgaggaacaaacgtctttgagaccgttgatgcgtcaccaatcacattctttactaacgtcttgcgattgatcgacaatgaaattgcttgacgaatcttagcgttattgagcgcctttttgattgtcgcgttactgtcttggaaattataaaccagaaacgcggtgatagaataagggtacgtggtatagtcagaactgctcttcatattcttaacttgttcactcgctaattgcgttagatcaagtttcttttcttggaacaagttcaatgttgtcgtagtactctcattgaccgtgtagttgatcttttgtaggtggacagctttcttatcccagtactgattatttttacaaactgccagctattattagttccagtccagccagtcaacttaaacggcccactgtagagcatgtactgagccttagtggcatatttattaccccactttttgaccgctttctcactaattggtccaaacaacgggtaggtcatgtaacttcttaaaataagtaattggcttatcaagagtcacaataaaagtatgttcgccttgcgccttgacgcccaatgtacttggtgactttttcccagcgacaatttcatccgcattcttcacccctgagaagaggtaggcatactgtgacttagttgctggagtgacggtccgtttcaagaatagacaaagtcttgcgcggttatcttcgaaccatcgctccactttgcattgcgaatcgtaaaggtatacgtcttgccatcctttgaaaccttagttgacttagctaatcccggtgtaatgctaccattctttcctaaccggtataagctttcaaaaatattacccgtactgccatatcccgacatattggaaatatcgattgaatccaatgaactagggtacgacaagtttaaaacctgactacttgcatacttgccattaccagaagactggctattgtgcttcccacacgcagccagcaccgtcactaatactaggggctcattaccactgctaacactgatcgcttcttcaaacttctcgcccctttacattcccattttgatgtgttgatctacttattcccatcggttgtaacaaaaaacgcctgttcagaatctcgtcagattccaagcgggcgtttcaaaattaacgatttgagctcaatcccgttatttttgatgcagagacgcttgtaattcaacgcaaatagccatgttgtttgattcacaacatgggcagcacatcatcatttgcattgttgatttttgcataattacgtctctccgatttcaataagatgtgttcagtataaatagttgcacttacttttgtcaagtgcttttcgagtatggcgaacgacaatcaatccatttcaaccaaaaaagccgctaacaccatctaaaatggttagcaagcttttcaacaaaactcatgcttaagccatccttatcgacaactaagcatctttttgtaattgttccgcaaattgattgaattttacgcagccgatgattgattccagacttagaaatcggcccgcccggaacaagggttcctagttccttgaggctaacttcacgatgttccaaccgggcaacagcgacttcttgtaattttggtggtaactgttgtaatcccaccgtggcatcgatcaataaaatattttcaatctgtttgctagaggcattggcaaccttatccatgttggcgttctcacagttaaccaaccgattgaccgagttacgcatgtcccgcatgattcgaatatcttcaaacttaagcatggcattggtcgcaccaaccaatgacaagaagtcggcaattttttccgcttccttgatgtacgtaataaaaccaccacgccgatcagtcgttcgtgaattcaagccatactgattcatcatctcggagatcatatgattatgttcctcatacagtgagtaaatttccaaatgataccgggaagtttcaggattattaaccgaaccgcccctcgctaaaaaggcgccacgcaaataagaacgcaccgcagcatcatccgttaacacttcagttggtgccacttcaacgatttgataatcctttaagatacccaaatcagcgagtaccatgtccgtaccggtcttcaatcgtacgatgtacaaattattcttatttaatttcattttgcgccgaacaatcaattcactatcgacgtcataaaattgtttgagtagccggtaaatacgccgcgcgatggccggattttccgtctgaatattcaaaatgaagtgatgattagcaatgctgatcgccccattcattcgaatcaaagccattaattcagccttagcattctcgcgatggacagcgaggttagtcaattctttcttaacgtcactggcgtatgacatgccacgacccccttatctgaaaacgtcggaatgaccgactagattcattaattcagcgacaacttggtcgccatcatgaaaggccccattatcatggagttttcaagaagttcgatgagattacgcgacagttttgttcacgtaaccccggaagtcatgactcacttgctttgaaacttcgttaaacttatgaaaatccatgtaatcttctggcactttttcggtgttaactaacaccgtattaataaagttctgccccaaatggcggtttaagacccgtacatgatcagcatcggagaaattatccgtttcacctttttgagtcataatattacaaatataaaccacttctgcatcagactcacagacggcccgaccaatatttccaatcgttaggttcggtagaatactggtaaacaaactaccgggccccaaaacaatctgatctgccgccataatcgcatcaataactggttgaactgcttgtggttccttaccattcttgtcagtgacccaaacgcgttccaatgacttatgggccgcggtaatttcggcttcacctactaactcggtaccgtcactaaacttaccatgtagcggtgagtgcctcgttggctgccgggtaaacatgaccatctacttgcatcatatttgataattcccgcaccgcgtcaaacaccccagatttcatttccgttagtgccgcaataattaaattaccaatcgcatgacccgcaaaaaattgatcatcaccctggaaacgatactgaaaaatatctttatacaaatccggccaactcgacaacgccaccattacattacgaatatcaccaggtggaaccacgttaacgtaattgcgaataatgccggatgacccaccatcatcagccaccgtcaccactgcggtaatatcgactgctcgcttacgcaagccgttcagaacaaccggcaaaccggtccctccaccaatcaccacaattttaggccgctgggtcttaaatgtgtattttctcatgagcgattaacagtttcctttcgtttctcaatatcacgatgactgatgtgcaccttgtagtgcttagccagcgcttcaccgatacgttgcgtcaaggcaacggaccggtgttgaccgcccgtacagccaatcgcaatcgtcaaactactcttgccctcggcttcatagccgggcataatgctttccagcatactcaagaactgctggtagaaagcttccgtagctggttgctgcataacgtaatccgccacaggtttatctagtcccgtcagcttctttaattcaggaatgtagtatggattaggcaagaagcgcacatccataacgatatctgcatcaatcgggagtccgtatttaaaaccgaatgatagcatttcaatatgaaaagtctcatcctgatccgtttcgaatttatcaaaaatcgattcgcgtaattcacgtggtgtcaacgtcgacgtatcaatgacgtatgaagcccgatctttcaatggcgccaataattctcgttctttgcgcacgccatccatgacgcgaccttccatggctaatggatgggaacgccgcgtctctttataacgtgacactaattcttcgttggaagcatctaaaaacagaatccgggtcgacacaaagtccgtgttgtctaagttagccaacatatccataatttcgtcgtaaaaagcccgcgagcgtaaatcaatcactaacgctactttctttattttacccgactcctcaactaattctgagaacttcggtaataacgctggtggcatattgtcaatgcaaaaatagcccaggtcttcaaagctttgaaccgcaaccgtcttaccggcaccgctcatcccagaaataattactagttgtaatgattctgccatgctgtattggccccctctagtccatattgttggtagtataacacaccgggtgtgtcatttctactgacgtgccacttcgacccgccatttgattccaaacagtattacattaacgcgcaaaaaagacccttaacaacaccctgacaccaccaatagtgagcgccaagtatcgctaacgagtcaatactgccaagctagttacgccgagcaaaagcaatcaagattgcgttgatgccaaaaactgcaaagtagaaactaaccagtacgttgaaactaatcacagcaatcattggattgattactaataagattcccaatgccaaactaataatatccaagattaaagatagaacaaaatacccggttccaaagacgcgtagatgtgagactacggtcagccgttcaatcgaatcgatcaagaaccaaaaggcaaagacgtaaccgagtaccagtaccccagtcggtgcgtggaataaaaataataaccccactaaaatatcaataatcgcaaacacaagggcaaagtttgcccgcaaccctgtttcacggcgtagttttgtgtacccaccgattgtggtgaccccgctaataattgcggcgatggcaaataaaaagactaaacttaaaagtgctgcttgtggttgcttgatgacaaagtaagcggcgatcaagaaaacgatccccgtcatgaattcagtccaattcaaaccccagcgatgatcattaaacatacatcaacatctcccatatccgatattaattccatcttaccagttaatgtaagagtttccaatttttctgatagactttatgttagcttaatgctttttcaaaatgtcaatagcattaaaaatggcctctaaatgccgaggctccgccacttagaggtcatctttaaaaataatatcaatggtcaaattgataagcattaattaatcagtggtttcagattgataggctgacaattgcgtttgtgcccgttgcaattcttgtctaatctgatcaaaaccagtaccacctagcgaatgccgccgttccaccgcaacttttgcgttcaaatcatggtagacatcttcttggatcagcggtgagattgactgatattctttgagtggaatatcccgcaacggccgctgtttttcaagccatccaagacgagcttccccacaatggcatgagcctcccgaaatgggattcctttgtggtttgcaaggtaatcggctagttcggtcgcatttgagaaatcgttagtcgtggcatcagccatccgatcttcattaacggtcagcgttgccaacatgccggtgaagacgtggagactcgttaacacggtcgtgaccgtatcaaacgccccttctttgtcttcttgcagatccttattgtaagcgagcggaatccctttcatgacagttagcaatcccatcaagttgccgtaaacccggccggacttgccccgaattaattcggccatgtcagggttcttcttttgcggcataatcgaactacccgttgaaaactgatcgctcaaactgatgtacttgaattcataactgctccagctgacaatttcttcacaaaaccgtgagagatgcatcatcaggatcgaagcattgctgagaaactcaagcacgaagtcccggtcagaaacggcatccaaactattatgatagacttcactgaatcctaatagtttcgcactatattccccggtcgattggaaaagtcgttccagcaagtgcagcggctcccaatggcgaaatatcggtatgcttcaggttaaactcgaagcgttccatgtcccgcttgaacatttggtaataagctaacaggtagtgcgcgtacgagatgggttgggcgtgttgcaaatgcgtgtaccccggcatgaccgtctccacgttctcactcgctttatcgaccaataccgtttccagttcatgtagccggtccaatattagtggtaattgatgcttcaagtacaagtggaaatccgtggcaacttggtcattccgcgaccgggccgtgtgcaactttccagcgactggcccaatctcttcggtcaataatgactcaatattcatatgaatgtcttcgttgaccgttgaaaattccaacttaccttgtttttgacgctcagccaaggtttccaaaccagcaacaatttgatcaacatcagcggcgggcaaaataccagttttcttcaacattttaacgtgtgccagtgaaccagcaatatcttctgcggcaagcaactggtcaaagctaattgatgccccaaagtcatcaacatacttagcacccgtttcggtaaaccggccaccccatagcttcttggtactcattaggcgtgtgccttatcagtcttagcttcggcctgagccttcgcttggacttgggcattaacttgcgtcggtaagccccatagcttaatgaaaccaactgccgcttgttggtcaaatgaatccgctgatgtataggttgccaagttcgtatcatatagtgagttgggtgacttccgcccctcagtaataacgttacccttgaagagttgtacccggactaccccattgacgacttgctgagtttgctttaagaaggcaaccatcgcttccatcaatggtgagaaccaaagaccgttgtagatcgtatccgcaagcttttgttcaatgattggcttgaagtgagctaactcacgctcaaacgtcaaatcttccaaatctttatgtgctttgagcaataccgttgcagctggtgcttcgtaaacttcccgtgacttgataccgaccaaccggttttcaatatggtcgatccgaccaattccatgttcaccagcaatctgatccaacttgatgattaaatcagctaggttaagtgattcaccatctaaagcaactggcaccccagcttcaaaagtgatttccaaagtcgttggcgtatccggcgtatcagctaaggccttcgtccggtcaaacgcatcggcgggcgcgccccgccatggatcttctagaatgccacattcattagcccggccccataagttttcgtcaatcgagtaagggctgtccaaattgattggtacgggaatattgtgttccttagcgtaatcgatctcttcttcccgtgaccagtgccaatcacgtacaggcgcttcgatcttgatatccggtgcaagagcgtggatggcaacctcaaaccgaacctgatctcattacccttcccagtacagccatgggcaattgcaacagcgtgctcttgcttggctaatgtgactaacttcttagcaattaaaggacgtgaaagtgctgaaaccagcgggtattcaccttcatacaaggtatgaccttgtaaagcaattaacgcatattcttcagcaaattcttgcttagcatcaatcatatatgatgaaacagcccctaattttagggccttttctttgattgcatccatgtccttgccttcaccaacatcaattccgcaggccacaacatcatagcccttatccttcaaccaactaattgcgaccgacgtatctaaaccaccagaataagcgagaataattttatcattttgtttgaccattgatttgtacctccgaaatttttatctttgcttttatcaatgacagtatcgtaccacccaatttaactttattcaataatattttaaatatattcattatttgcacaatattcactaaaatatagaatttttttatgcagatattcaccaatatcagtatattttttgttatttttgaaacactaccttaatctaatcttagattgttttcccacgattcaggaccgctaagctcgcacaatgtcagtaaacagcaaaaagagcctagcttttcgttatgaaaagctaggctctttttaattggtggccggcaccaccattactttttatattttggtctattcaacgactttgcgtacaaatggatccgatgaaattccttgcgataaaatcaacttggcccattccttagctgagaataaagaatgatccttgtaattcccacagctatcgatggtcgtcccttgtacgtcttcccacttagctgggccagcaatgaattctaatgaggacttcaatgccttagcaacttcaacggtgtcatgttcaccccaagtaatcaaatgaaaaccagtccgacaaccaaatggtgagcagtcaatcacgccatccatccgatcacgtaataaatccagccaacatatgttcaatcgtgtgtaagcccgccgtatcaatagcggtcttgttaggttgaactaaccgcaaatcaaaattagtgatggcatcacccttaggcccattttccaccgtaattttacgaacgtaaggtgctaaaaccttggtatgatctaatgtaaaactttctactttagccatgtacaaacaactcctctaaattaaaattacattacaaactcaagtgtagcacattgcccgttatttagcaggtgcagttgcttcacgtgctcgatcccgttctagaacgggcttcaagtattggccagtataactttcagccacttcagcgacctgttctggtgtcccagtagcaacgattgttccgccgccgtcaccgccttctgggcccaagtcaatcaaataatccgccgacttcacaacatccaaattatgctcgatgattaacacggtattacccgcatccaccaaccgatccaagacaccaaatcaagcgccgaatatcttcactgtgcaacccagtcgttggttcgtccaagatgtagaaattcttccccgactgttgtttgtgcaattcggaagctaacttcatccgttgggcttctccacctgataaggtcgtggcgggttggcctaacttaacatagcccaaaccaacgtcaaccaaggtctgtagtttccgtcgaatctttggaattggttcaaagaacttaacagcttctgaagcggtcatttgaagaacatcggcaatatttttgcctttgtattcaacttccagcgtttcagaattgtattgcttaccatgacacacttcacaaggtacaaagacatcgggcaagaaattcatttcaatttttagaatcccgtcaccgtgacaagcctcacagcgacccccttagtattaaaactaaagcggcccttcttgtaaccacgtaatttagcttcattcgtttgtgcaaataaatcacgaatattgtcaaagacacacccagtatatgtggccggattactgcgtggtgttcggccgattggactttggtcaatattaactaaccgttcaatattcttaataccactgacactcttatacttaccaggcttttcagaattacgattcaacttctgtgccaatacgcgtttcaaaacatcgttaaccaaggtcgacttaccagaaccggaaacccccgttaccacgacaaattcgcctagtggaaaatcaacgtcaatttgcttgaggttgttttcggccgcaccagtgatacgaatcttcttaccattacccggacgccgagtttcaggtagtgggataaaccgtttgcccgatagatattggccggtcagtgacttccgcgagcgagccacttgcttgggcgttccggccgccatgacctcaccaccgttttcaccggcacccgggccgatatccacgatatagtcagcggcccgcatcgtgtcttcatcatgttcgaccacgatcaacgtattccccccagatcgcgcatcttcttaagtgaaccaatcaagcggtcgttatcccgctgatgcaatccaattgatggttcatccaagatatagagcacgccggacaagttcgatccgatctgtgttgctaaccggattcgctgggcttccccaccagacagcgtccgtgcagaacggctgagcgttaagtacgccagtcccacattttgcaagaatgataaccggtcgcggatttccttcaagattggtttagcaatcacgagactttgttctgataagctcaactcgttaaagaaatcgagttccttaccaatggctaagtcagagaccatcccgatatgttcgccaccaactttgacagacagggccttgcgatttaagcggaacccatgacaagtctgacaagtgagttccgtcatatactttcgcatcacatcgcgggtgaaatcactattcgtttcgtggtagcggcggtcaacattgttgataacgccctcaaacacagtcgtcaacatcgcgaacaccaccaaagtcgttctggtagtggaaatggaacgtctttccgttagacccatacaaaaccgtttgttgatcagcttttgataagtcttcatacggcacatccatcggaatttctaactgttcacaagcttgcttcaacatttcaggataatactgtgaactgattggattccaaggcgctaacgcaccttcagccaacgtcaacgacttatcaggtacgacaaggtcctcatcgacttctagcttgattccgagaccttcacagtctggacaagctccctgaggcgcgttaaacgagaataaccgtggttcaagttctcccacagtaaacccacagataggacaagcataatgttctgagaacataatgggttcgccaccgattacatccgcaatcgcatagcccccacttaatcgcaacgccgcttcaaaagaatcaaataaccgagaacggtcaccggacttcacaacgatccgatcaatgggacgatttcaatcgtgtgttgttgattcttgttcagttcaaaagtttcactgatatcatgaatatcaccatcaacacggacccgcacgaaaccttcacgcttgatcttttcaaagatctttttgtgctcgccctttttctggcggacaattggtgataaaatctgcaacttcgttcgttccggtaatttctgaatccgatcaaccatctgttcaacggtttgactcgcaatcggtgtcccatcgttcgggcaaatcggttcaccgactcgggcccacagtaaccgtaagtaatcattgatttctgtaacggttccgaccgttgagcgcgggtttttggatgttgttttctgatcgatcgaaatagccggactaagcccatcaattgaatcaacgtctggtttttgcatctgtcctaagaattgacgcgcgtacgctgacaaactttccacgtagcgacgttgtccttccgcgtacaaggtatcgaacgctaacgaactatacttacctgagccagacagccccgtaatcacgactaatttgtcgcgcgggatggtaacgtcgatatcttttaaattatgggctcgcgcaccgtgaatgacaatcttatcatttgccaaaaaaaggcctcctcaatctcaagccagcaacccgctagctaatttgtgctttcaattccatgaccgtatcacgcagcgttgcggcttgttcaaagtcgagcttcttagcggcggtcttcatctgttcttccaacttactaatcatatctaattgttgttcacgggtcatatcatcaaagtcggtttctaagaagtcatccttcttgcccgcgtcttcagtggtcttcgtcgaagcaattagctctggaatggccttcttaatcgtatgtggcgtgatgtgatgatcttcattgtacttcatctgtacggcacgacgacgtgcagtctcatccatcgcggctgcatcgaatcagtcgtggtgtcagcgtacataatcactgaacaccgtgctcattacgagccgcccgaccaatcgtttggatcaacgaacgctcgttacgaaggaaaccttccttatccgcatccaaaatcgcaactagtgaaacttcgggaacgtcaattccttcccgcaacaagttgatcccgaccaacacatcgaacttgcccagacgcgggtcgcggatgatctgcgttcgttccaacgtcttaatatcactgtgcaagtaccgtaccttgatgcctaaatccttaaagtagtcggtcaaatcttccgccatcttcttagttaacgtggtgataaagacccgttcgttgacctcaatgcgcttattgatttcacccactaagtcatcgatctgacccataatcggtcgaacctcaatcgtaggatccaataaaccagttggtcgaataatttgctggacgacatgcttggtccgatccatttcgtaagggcccggcgttgcggacatataaaccacttgattaatatgctgttcaacttctttcaagtttcaatggccggttgtccaacgcacttggcaaacggaagccataatcgactagcatttgtttacgtgctcggtccccattatacattccccgaacttggggcatcgtcacgtgtgactcatcgaccacgagcaaaaagtccttcgggaagaagtccagtaacgtatacggtggttcgccaggtttacggccatccataaaacgtgaatagttctcgataccactagtgtagcccatttctttgagcatttcgacatcataggtcgtccgctgcttgagtcgttgcgcctctaacaatttgccatcggctgtcaattctttcaggcggccatccaactcatcttcaatgcccttgatggcgtgttccataatcgcatcattcgtcataaagtgggtcgctgggaagatcgcaacatgttcacgatcagctacaatttcaccggttaaggcgtcaatctcacggattcgatcaatctcatcgccaaagaattcaacgcgcaatgcgtggtcatcccgtgaagccggaaagatttctacgacatcaccatggacccgaaaacgcccccgctggaaatcaatatcgttacgatcaaattgaatatcaacaagtttacgcaacagatcattgcggtcgatctccatgccgactcgcagtgagactacgtgatcttggtactcgtgaggatcccctaaaccgaaaatactggagaccgatgccacgacgatcacatcgttgcgttccaataatgagctggtcgcagagtgccgtaacttatcgatttcatcgttgattgccgagtccttttcgatataggtatcactcgaaggcacgtacgcttccggctgataataatcgtaataactcacaaaatattcaacggcattgttcgggaaaaacttcttaaactccccgtataattgacccgctaacgtcttgttatgtgacaagattaacgttggcttattcacctttgcaatcacgttcgaaattgtaaaaggtcttcccggtcccggtcgcccccaacaagatctgctctttttctcccgattcaatgccagcagttaattgctggatcgcttggggttgatcgcccgttggttggtaatctgaaactaagtcaaaatgattattatctacccgatcaatcaaacgtagtcctccttttaaacggtcacccgttcatatcatctattgataactaaatcttactgtcgcaccataaaaaataggcaagcccgcgcttccctatcacattcaaatcgcatttaattttagcacatcgaacatactttcgccattaatcggattgcggcccggccgttaaaatctgggtcgtcagcgcctgtaattggtcctgatgcgtgaacggttccgctaacatctctggcagcactgcttttaagaaatattgaacactagtcatctttttaaacgcgacaattgtttttaaactttcttgataaatatccctaaaaactggttctggattaccctttttgaatttcaccaaacgactcatacaataggtcaattttatcggctaccgacaatatctggccttctagcgtttcatccttgccttctgatagacgccgtgaataagctgcctgaaactcagccggaatctcattttgcacaaaattttgtgataatttatgctcaacatccgccagcatcgtccgtagcgtcggcgttgcgtacttgacaggcgtcttaatatccccgataaaacgctcattatagtcgtgattcagcgccttctcatagagggctcgccaatcaacaatttgtccggcattttcttccacatcacctaaaaattgggcaacttcggcaactttgaatgaatgcgccgcaactgaatgattctgatacttgaaaaacccggggcccgttgaatcgtttctaaattacttaagctctgaaaatattgatgcattcccattgcagcccaccatccttcaatctaatttggcctaagtgtaacaaaagcggccccggggacgcaaacccggagcgctttcgctgattagcttaactgttatgcaatattaaacttgctgatgtgaatgaacctggttcggtaatcgtaacataaacgccattaaataagagacaatcaagaatccggccaccactagatatggatagtgataattcatatctagtaacatccccgacatgattgggccaacgatattgccaacactcgttaaggacatgttaagcccattgattagcccctggttggcctcacttgctttcgttaatagggtcgtaatagcgggccgcaaaagatcgaatgccgaaaaataacgagcgttgcaaccatgacagcaactttcgaatgagcctgcgtaatccagatagtgcagagcgccgcagctgcaaagcacacccgaatgacccgccgttcgccccaacgctggacaaaggtatcaaatagtgccacctgtaggaagagcgaaatcaaaccatttaaagtcaagaccaaacgcaatgttgctcagactaaagtgaaagacttcattcacgtaaatactataaatgctctcaaacccctgtaagccaaaggaagacactaaaatcatcgtaaataatataataatcgggacggtccaaaatgcccgcgtcatcggatgattggtcgtcgttgtcgtggccgtaattgcttcgcgatcaggatcaatctgacgatccgcaggcaacagaatgacgagcacaatggcactgagtaatcccaatgcaccagcaacccagaacggcgtcttataactaataccagccaataccccaccgataccggggcctaaaatcaagccaccactaaaggccgccgataaccagccaattactttagctcgctgtcgtttggtcgtaatatcggatgctaacgccatcgccgtcggaacgaccatcgctgctgataagccaccaacaatccgggaaatattaaagacccacagctggttggttagcgcaaatagtacttctccgagaccatatataagactagccctaccgttaatacgggcttgcgaccaactttgtctgaaacccggccaataatgggtgaggccacaaattgtgccaatgcgaatagcgcattcattattcccatatcggtagccgttaaatgcagttcatttttaataaacggcatgactggaataactaaactaatccctaaacaaactaaaaactcactaaaaactaaaattaaaattgcgcgtcgtgtttgtcgatccatgcgacctcacctcttcaatcaattgttaaatttacaccgctttccatcatatcagggacccggattgaaagctagcagaaagtttgacaccatttgcaacccttttagtcggtaaaatatcggccaatcagatacaataagcataactaaattctaaggaggacctactatggatcaagctttaactggtttcaccaatattcaacacttagactccgaaatcatcgttgacctgcgttatgccaccactaataactttactcatcaagtgatttacgactttaccacggccattgttcgcactggcacggcccacaaactcgccaaggcaagcgccctggttaaacaacaaggttatcgactcaaagtctgggatgcttatcggcccgtcagcgcccagcgccgtttatttgaagtgtatcctgatccagaatttgttgcccagcctaatcctaatttcagccaccaaaaaggcgtcaccttagatttgaccctggcccatcctgatggtagtgagttaacaatgccaactgccttcgatgacttcacggcagctgctcaccgtgacgctcctcgaaccgcacttcaagaaaaaaattatcagctgctggacaccgccatgaccgccgcgggctttgtcggctacgttaacgaatggtgggactaccgcgacaccgaaatggacgcttaccaacccctagccgccgatcccaacgactatgcttgaccaatcgctttcaaatataatataaaggtggccgccaaacagtcaggttatgaaacccactgtttggcggtcaccttatttggctcattatttttatggattcaccagcacttattattaaaacatgctagttagttggattgttgcccgtcagcatatgcgcgtcctcgtctgacttccaggaaaccactcgagtggcagatgaacggccgcttaacccaagctaatctgtcgctgaaccatctactccgttagacttggaacaaacgttaacatagcacattcgttttgaataccatcccagcgattggcagcaatacctgaagaacggtatcagacacactccccaaacaagtttacgctaatctgaacttattccagcgggtctaagctggctgttcttgattttaacaaccagcaccttctgaacataattagtgcaaaaacttaattattccgacgatagccatgttcctgatctactgcagcctgcgccactaaattcaagtaattaaacggttcatcaaagttgggtgagaatagcatatccatgaaggctaattcatcaatcgtattaccattatgaatcactacggacaacgtatttgctgattgtgaaacttcatgagcactcattagttgaccacccaaaaccttccgcgtttgttgatcataaaccaactcaatcatgactttcgccgtggtaggcataaagtccggccgataattgccttcataaaaagctgcttgggcatcaaagttagctgctttggccgccgttaaggtcagactgcacaagccacggtctgatcaaaaatcaacatcccagtcgtcgcttgcgtaccaattgcacctaagcgtttatcaaagatattaattcctcgccagtgcaccttgccgaattgcatgtgagactaatggcatataggcgtgttccttcgtaggattaaagttaacttccgtcacatcgccagccgcaaatatatccgggttggaggttcccatataacggtccgttacaatggccccccgcttcgttcggttgacctgtcccgccaataactctgattgtggaatcaccccggacaaataacagccatatcaaatatttcttcactatcagcggttgcaactcgtagtcgattatcagccgtatcactaaaagccgtcacttgtgcattggttctaacttggatgcctttcgtcgctaacaagtcttcgatcttctcagaaatttgtggatcaagatactcattaattaagtgggggccccgttgaaacaacgtcacagtgtgtccagacttcacgtacccctcagcaagttccaccccgaatagccaccaccaacgattgcaatatggtgtgcatgtttagctgcttcgtagagttgctgggcctgttcacatgttttgcaaagcatgaccttaggattctctacgcccggaatagccgggattgcagtgattgaacccgtcgccatgactaacttatcatagtgatccgtttgtaattcttttgtaattctgtaaattttgagccaaaattgtatgcttatcagcattcacattgatcacatcatactgcatccgcatctgcacaccttgttcactaaattcactaggattagcgtacaacgcttgatccaaattatggatggtacccctaagtgtagataagtcccacaagacatatatgaaatatccgcgtgccgttcatagacggtaatttcagtgcccggataatatttcaagatttgtttcatggcggcaatccccgcatgtgtacagccaataatggcaactttcattgtttcgcccacagctttcattaaaagttaaaatttaacttggattaagttaaacatttatttaagttgacgtatacttagagtatacagcgattcggttgatattaaaacgattcaatgattttaaacttattataaaaggcgatggtacttatggaaccaatttaccgctattttgtacaacctcaacttaacttactcaacaatacagtttgacggatacgaactactaatcaaacaactaaccccagacggctggcgtctgcctgaatcctttgccgcaattagttcacaagttacctctgatctgctcattgcaacaactaaaattcttggactaaaagttcgttattgtgcagtcaacatcagtcgcgaacaattgatggatacaacggttgcgaaggccattattcaaagtcaggttcagctctatcccgctaaattagtcgttgagctaactgaggaacgtagtcctaaggattatccagataccatgttaatcccacacttacgggggttcatcgaacatggtatgcaaatttcacttgatgatgttggtaccggaattaacgatttcaagagtatccaagaaattttgccattagcttctgaattaaaatttgcgttgcaaaacttccgcagtgatatcaaagatcctaagattcagcaaaagctccatttttggcgggccatcagtagtgaatacggattgcgttttaatcttagaggggattgaagacgccgaagatgatcgcttgagtagtcacttcgatattaatcttcgacaaggctattactatggcaaaccgcaattattacgcctacccggtgaccccgtcaactttgaatatccgacaatgaattaatttctaatatgaacaacaactaaataacgccttacgaaattaacttaaaatttcgtaaggcgttatttatcacttagcatggctagtcagctgggccgtacaacttctgactaaataaccaatttattctttaataaacgcttgaatggcatcttcaaatttcgctaacttatcattagcttcttctaacgtactacctagcgttccaatgtagaacttgatctttggttccgtaccagatggccgaatggcgatccaagtgccatcatttaaatgatacttcaagacattcgcctttggcaaagcaattggtgccgtgtggccatcagcaaagctttccgtttgactctggaagtcttcagtcccagtgacatcgtagccggcaaaggcagttggtgcttcgcttcggaacttagtcatcagagccgcaatcttatcgctgccgccaacgccatcaaattcttcggacgtggtttgttcgcggaagtaaccgtattccttaaacaagtcttgtaatccatcataaaggttcttaccttgttgcttataataagccgctacttcggctaaaagcactgtggtttgaatcgcatccttgtcatgaacaaatggtttgattaagtaaccgtaactttcttcaaaaccaaacatataggtatgttcgccagtggcttcaaaatgttcgatttgttcagcaatatacttgaaaccggtcaagacattgatcatcgtgacaccatatgaagccgctactttagtagcaaattcacttgaaacaattgacttaactgcggccgcattggtcggtaacgtcccggcatccttgtttgcttgcaagatgtagtgtaatcaagacagcggcaatttgattacccgtcaacagaacatactcaccattaggttgacgaacagctgtccctaaccggtcagcatcaggatcaaccgcaatcaagacatccgcaccttctttttacccaaatcaatggccatcttaaaggcttcaggaaattcaggattagggaatttaaccgtcgagaattcagggtcagccacagcttgttccttaacaacactgaagtttttaaacccggcattcttcaaagccttttcgccaagcatccggccagtcccatgtaatggtgtgaagactaacttcatgtccttaccgacttcatccactagtttttgattgatcgtcacttctttgaccttagctaagtagtcctgatcgacatcatccccaataatggtttccgtcttatcagctaataattgttgttcatcagcgacggcaatcgcaaagacatcgtcaactttacgaatatatgatgtgataagatcagatttcagcttaggtggcatttgaccaccatcttcgccataaatcttgtagccattatattgcttcggattatggctcgccgtaatcatgatccctgcgtaagtatgcagatgccgaacggtaaatgaaagttctggggttggccgcaagctttcaaaaacgtatgacttgataccatgttggcccaatactcgcgcagattcatgcgcaaaatcttctgaatgatggcgggaatcaaaactgattgctaccccgcgttccttaacctcagcgggcaaggtatccatgaagcgtgctaacccttccgttgcttgacgaaccgtataaatattcatccggttgataccaggtccaagtacccccgcatccccgcggttccgaattccattggttcataaaaggcgtcttctaaggcggcgtcatcgccagccatacccgtcaattcttgttttaaactagtttcaagtgtcgcttggtttttccaggtattataagtatcccgccgaaactcacaaaaaccatctccaattccgatatttgttagtgcttacaaaaatagtatacaacattgacacactttacaaagtaaaatttactaagaaaatccattaattaatgcattttaaatgcgtagtgggcccgcatcagtgcgaatacccataaattctgaagtgctagttagttcagtcactatcaaaacttgctataataaatcttataaggaggccatcatgactttttattcatacaactacttagtccatcaaaataacaatcatactcttgtccaactcgcagccatcggcatcattatattaataatcgccatactcagctggttatggtaccgccataaaacagacctaaaataccgcgacttattcattatcatggttttattattattgctgctcgtcggcattcaatttaatgaatggcagacaatcaaaaatagtttcaaccaaaaatcacaagtgacacaaattatgcagcgtgtcgccaaagagaaaaaggggttcgtaaaaccgcggtctggtctaatacaagttctgtcagcagtgggatgctcattaaagtccatgaccatatctataacgtgacgatcaatacggatggaaacagttataccctgactaaagccacaccgattcaatcaacaatcaattatgttaaggaggggcaataaatgttttcatactgggatgtgacgatcaaactggccctcgggctattgaccatcattctacaaatcaatctatctggtaaaagtaaccttgcgccaatcagcgccctcgaccaagttcaaaactacgttctcggtgcaatcgttgggggcatgatttatagtaccagcgttactgttttacaatacattttagtgcttctcatctggacactgctagtgctggtcccgcgattcctaacacatcacaatcgctacgtgaaacgtttgattgatggacagccacagctattgattaaaaatgggcaattactcgtcagacacacggccctcaaaaatgggatgagtgctaacgatctgatgtttcgcttgcgtacggaaggtatcacggatattcgctacgtcaaacgggccgtacttgaacaaaacggccaactgacgattacccaagtgggcgacgacgccgtcaagtatccaataatcgtcgatggtcaggtcaacctcgatgcgcttgaaactagtaatcatgatgaagcctggttactgacccaattgcaggcccagcactatactgtcagtgatatttacctggcaacgtatactaacaagcaattgcttctatttccctatcaacactaattcgcgaacctttggtcatcgtcaaacaatgactaacgctatatttaccaataaaaaatgcgtggctgatctcaattaaatcagctacgcattttttaattttatttaattgttaactttgtcgcctaaagcagtgatataagtgtaaacgccttgaccggcagttccgccttcaccaaccgccgtcgcaacttggcgtaaatctttcttacgaacatcaccgactgcaaaaataccagggaccttggtttccatgtggtcattagtttcgatccagccgttttcgtcagtaatcccaagattactgaatggcttcgtaattgggttaataccaacatagataaagacaccatcgaccgcaatctcactgtcttcaccagtcttattattattaaccttaactcccgtgaccttcttatcatcaccgatgatttccgtcacgttgctattccaaacaaattccatctttggattagcaaaagcccgatcttgtaagatttgttgtgcccgcaattggtcacgacgatgaataaccgtcaccttatcagcaagctgtgtcaggtaagtgccttcctcaatcgctgagtcaccgccaccaacgacaactacatgcttgttacggaaaaacgctccatcacaaactgcgcagtatgagacaccgcggccaccatacgtatcctcgcccagtaacacccagcttacgatattcagaaccagtcccaatgacaagggccttagtctcaaacgtatcgctatccgtcgtcacaattttaacatcgccacgatcttcaacggattcgacgctaccatacgcgtattcagcaccaaactgggtcgctgattcatacatgtctttagccaaatccggccccaaaacagatttgaagcccggataattttcaattgcggcggtattattcatttgtccaccatagattccgcgatctaatagtagcactgatagattggctcgtgaagcatagagggcggctgtcatgccggcgggccccgcaccaataataatcacgtcgtaactctttgccatttctaaagaccccttccacttaaattcctatgacgcttaatatacccccaaaatttacatttgtcgactatcttgtttgtacacaaccgaaatcaacgcgccacatcatactcagtttctttaatgccagtattcatgtaaaatcatacgggctcttcatcttttccgcatcccaactcgcgataccaaccaccaataagatttctaatgaatttaggctggttgagcgttgtaaatttttttcaaaattagatttaatgcggttcgctgcaatttgagcgcctggttggtctgaaaataacaagatggcccacgttggattattctgatcaagggaataggtaatatcgttatctcgcgttgccgatgtaatcgtatccgagaccaaccgcaataaatcacggtattgttgttcactcatcatccgtcgaatttcattatagtatcgcacccgaataataaccgtggtaaccggtaattgaaaccgtcgattcgtttcaataaacacttgtgcatcttgaatatatgcgacagttgttcgcaaattggtttgttcgtcaaaggcccctcgtttcataatatctgctcgtagcttggcattggccgcttgcaattgtattaattgccgggtcatgccataaaaagtagctgacaaaagcaacggcataatcaaccaaaaatcatcatcattggaattacggcgtgatgcgttgaattaatataaatcatgacgattgcctgagcaaagataaatagtaagttagccattagaccagtgaccacaccgaaaaataagtcatcaaaatcataatgatcgttacacctaaatagatcgtattaagtgtgatattaggggttaacgccatcagtacggccatcgtgctaataagcgctaaaaataataacaaataaacgtcagcaaaaatagatgttcgttgatcatcattcatggtgctgcccctttcgctctaacaaaccacttttacgcataatcaggaatcccgccagtaaaatgatcaccacgattagcaacgcaatacctaaataaatcactagcttagaattcttctgaataactgttttggcgttcacgccatcattaactgtcttatgcttcttaaaacgataattataatgtgggattattatcgtgatcgacgacaatcgcatcaccttgatactgggcaatgttccgttgaaaattgatttgagtagacgcccggtagacatcactactcttcgcggcggttacaactagcaatcccgctcgctgattatacggtgagcgtaacagctgggcagtgccaatattttgaccatacgttttctcaatactaagtttctcatttgacaggaacccagtaaaatgtcgattatatttaaaatacagcttagaattcagagaccgaataaacgcgttttgagctggcgtcccaaacgcaattacgttgctatttttgagtaccgttttactaggctgatgggtataaaactgaatattgccagtattactttgcgcataagttccaataagattaaatatattagttagcgtttgaaaatcgtcactagtcagcgttcgtggtcgaacaactgcaatgtggttaaaggtcgcattcttcaaaaacaaatatggataattcgtaaataataaagctgcgactggctttgacttaatcgtcgcttcagaatcagccttaatcagcgcccacggtgtttgggcattatcactttgagccgccccactcatctcaagatcaaaggcgacacgaatcgtgaaactatgccctagcgcttttcctttcggcagactaacggtcaactcatcattattggcacgcgctgctgtgagtcttttactacctaaagcggaatcatttacataaaccgttacaagcgatcgtttaaaatccaggttcttagcatagcgaaaatgaatccggattttcgaaccatcagcattggtccgatcaacagggagactaacaaaataagtacttgactgatgtttagcgccagtcaaataatcatcgctggtcgtcaattgctttttgccaccatattgtagctcagaggtaaacgtctgtgtgctgttactgatgtatttcgtatctgctactgtttctgcattaattctgctactgattagcaataaaccggcttgccttctgcaataatttggtattgaaggcactcacaattaaataatgtttaccatcatgcgtatatgtcttgataactgcatgttctcgcagtcgctgacgatcaagttgctgctgaaacactttaggcaaatgctgataagtcgcaatgaccaactgataatcagcctgtttagccaccgcggtatctgccgttgttaccgggatctgtgtattctccgtggtaatggtccgcgcctcacccgttaacgcatacatgccagctgacaactctgcgtttgatgcttgatgtggcagcgttatgactgaattagcattcgcgatggtatcagtcccagaaaaatgcgcataaaaagatttaatagccgttgttgggggttgcaagcgatactcaaagttagcattcgccccattgtaaatcgtcaaccagttggcggtgtctgcaccaattgagaactttgctggccttttttattcagtagggatctgcccactgatctttaactgattttcaccttgaattaaccgcagtgggacttcgatagccctagtttggagtccagtctcctttttgggccggaatgagtaaaacttcgttccgttcaacgacaacgtaatgtcagatgtctctcgattggccaactgcgaaatttggaaatttagattaatcgtcacttttttgacttgccaataatccattttaataaaatacatattggcctcaactgcatcaccagacagtgtcgttgttgagttttgaaaaggttgcgtataagtttgtagattattcgctgcccgcccactgataggacagcttagattactacccatcccaattaataaagcgagcatgcctattaaccagaagaaccacttactgataccgtttggttttataccactttgcttgttgatgaaaaacttgttcacgaacataccccaccattccatgtgcagccactgccagccacatctgactatagactaagtacataaaaacaataatcattaaattggcaatcgtcatttcccctttttccgttgtaattgtcacgaacgtactgattacaaatgtgatgatggccattagccatagtatattgctgaaccctaccaagtcggagtgtgcgattccagctactgaaaggacgaacatactatctgacaaaatcagcgacgtcattaataaaaagtaaatcgatagaaagtacaacaagtcaaatcgaattggccgccccgttttagtgaaaagtagccgtgcgtttttaaaatgacataaatattgcctttgacccaccgtgtccgttgatgaaaccacacatctaaagtttggggttcttgttcccaggtaacggctaggggttgaaagcgaatccgatatcccattcgataaacgcgaaaactgatttccgtatcttccgccagtgctttaacatcccaaccaccaattttctcaagaatatctcgccgaataacataattggtccccgggatcgtgcataatttaaacaacttttcccggcccgcctgagccatccactgaaatgatagcgtctcaatattgataaagcgtgtcagtattgatgcattcttgttccgcgtacgaaatttaccaatcactgccgctagccgttgatcactcattaactcagccaccaaataccgtaatgccgttctttgaggtgtattatccgcatcataaatcgaaatcaacgaaccacgtgcctgtttaaggccaatattaagcgcattcgactttcccttaccaccattagtcttatcagtattgatcactttcaagtttcgatgtggatacaatgactgcacttccgccagtaattcagcagaattatcatccgaattatcattaggcaaattacaagtttaatccgaacaagcccggaatctttcaatggcagtctgttgatgatgtatttttaatggtcgttgattaattagttcaagtgctgctaggatctatcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccagccaacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaacccggtccaactcatagctaatcgtagctttggcgacgcctaaggcgtcagccattacttggtaagatttattcctctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccattaataataataatttcataacgatccttgggataatcaaaattcaataacgactgtaacgttttgacgattacaataccctcgttatgcgcgggcaccataattgagacaaagggtacctttaccggtaattgaggttcaggacgtcgcaccttttgtaaataattcacatagcccgcaattgttaagacaacgttcacgactagaatgccccaaatcgacaatacagccaagaatagaaaataatctaaaatactaatattaattcctcccgttatgatagcaacgatgccgtcccctacttaggtttaaacatattcaaataaacccgccgaccaatcacaataaacaaaaattcccaatgtcaccgaaaagaaaatcaataacacactcccctgagttttaaagaaccgattcatccagctttctgctggttttactgcagccaaggttgtcgtcgctggcgcattatcagtcacttgtgtgggcgcaccgtttaacaaatacgttccacgccgataactgatcgtcgctgttccactcttgagcatcgtcgttgtcatttgttgtgcaaagcggggtcaaaccactgatagttcattcggctgagttgtctagtcaaattgtgtaaactcgtttcactatctggcatagtcattgtaagtgcggtgggaatggcaaaattcagcgctaacttactgagctgatcaccagatttcagcgtttcaaaggatttagcactaaccccataaaaggcctgatcaaataccgttgcttgattatcttgatgggcataagtcgtcaccttaggatcgggtaataagagaacctgattcgccttagttaaagcgttctggcggtagaccctgtcctggttccaataagcggaagcactaattccaactggataaacctgattctgtgctaactgaatgacgtaactgtccatcaacttgctcagtccaggaccgctacttgccgtaacaccaccaacgacaggtgtttttaagaaaataaccccaccacggttttcgattaaccgtaaaactttggcaaagcgttgatacgctttgaattttgccattagtgccaaccgttgttgtgctaaccgcaaatggaatcccttgttgatataaggtcgcactgagtttattcaacaaattaagattagaatacggcgttaccttagtaatcgttaacaatggttgataatgactacgggtaccgaataatgttgccattgtctgagtagctaacactaaactataacctccagttgaaagataaggtagataaccgtatcgaccaacgatggttccataaggatattcatgttttagcgatgattgtgccctcaaatagccgattgttttggccttagcgggtaactttgtgagtgccgtcatactgctcataaatggtaataattggcgaacttgttgatcattgctctgaagaaagaactgttgttggtaaactttgaccggttgggcattcaattgttgggcctcaatagcggtcagatttgtgccaatatgcagcttcgtaccgctgaactgcttacgatccttgataagacacgctgcattgttgagcttagtctgcggccagttaattagcgtaataacgccttgatagtgtcgtagttcgccagcatgataatcttcggccgccaccgttttgatgctaatgtgtagaccggtcaggattcgttgaatcatcgcgattttggtttgatcattattggccacattccgcgaatcataaaccagcataacgtgtgttgctgatgtttgagcgtggatctctgtcggcaataaccagctacaaagtataatgacacccatgattaccaactgccataaccgcttatgcatcttggtcctcctctcgataggcatgccacaaacggtgatttaaggtatccgaaataaacagcatgacaattagatcaatgctaaccggaaccataaataaatgttttgctaagtctgcatcaccatcaccaatgattgaaataattggcacaaaaataaaaatcgacaaaaacctaatactaagaaaaaccgcaagacgccttcgattcgctgctgacgcaaatcattataaaaaccaaccagataaaccatcactaacgcaactactagaagacaattaaaggcaaacttttgtggaaaaaaagccccggcaatctgactatacgttgtaaagaatgttagttgttttcctgcgggtgctcctgacgcttgggtgtaatccccaaccgctttaacttgagtaatcatgacatcggcggcggcaagatccatcaatttgccaaactgcttcagatgagtcgcataatactttaatacccaaccaactcccagcttagaaaccaagtttttcttaacataagaaccagaagcttgaatcgtcgcaaactgtttagcgtagtagtcttgtgactgcattaaggcatactgctcatcaatcccattctgagcaagatccttactaggatcatcggtttgggtcaagatgccgtgcgaaaaagtctgataggtattgatatccacaaagtcttgaccgatcaattaatataggtcagtccacccgtgatcaagatcatgaccattcccgcaagcaagtacacacgcattgcgttaaagtgtggcaaaaatagtaacccaatcgtcacgaccacaaagctcaatgctagcggggcgttttgtgacttgttagttatcaatagaactgtacaaacaaaatacaatgcaacgagtggccaccgccgccgatatcgttgtcgcgctagcagtaagacggctgaaaatgagattaaagttagtcctaacatttggggctcagcaaaaaagaatttaaatacaatgtaaatgaagaatcaccaaatactagaacgactaatcccgcaatcagataatttcgaaaacgcttggcgggatacgtcaaagcatccgtcaataaataaatgccacccagataaggaatcacattcacaatacccataaaccggatatcaaataccgtcttactataaaataatttattgagaccgatggccactttcacaaataaagggctgagatgaaaagttcaccgatcgatagtcgttgtagtacttcatcaagccaaatttctgcgttacaaaatcaaaatagttgtagtgcgttcccagcaacttataaataccattggtatacatcgcccgataaaaatcgccattatcagccagtccgttaatgggcggtacaaatgccacataggcagccaagccagcacaaagtaaagttgcgagtagtgggggtggcattagctgttgaaacagccgcgttgcgcgccaaaattgttgttttaacttagtcacaaagattacctcaatctctaattaaacgctgcgtttagcgccgtcaaattactatatgaatacacttgcttagttttggcatccccaataccaccgttaatcggcgaactgtcttgctgtacccgcaatcgccaaacattattcatcgcaacttgataatgcttttcatcacccagcgtcgcaaagatcgacgccgctaacgcatagttggcccgctgattcaccaccaacactcaccgtgccccttgtcgtataaccgtttgctaaatcacggtgggtgacccgttgaatcagccatcgccgactagtcgcttttaggtgaccaacttctgctaaatgcaataaggtttccaaagcctctgatgtattcaggttaccatcactatattggctagtggtccattggtaactttttgcatacaagggaaaaacatcacctaaataaccgcccttaaggacaatcaattgcttcttatacgcactccggcccttcttagtatcttgttcaaaatacttaagtgttcgtaaatcaaagtaagctaaactgcccgtcgtagttgccttacgcgcatgaacatcgtaataatcgaccaggtgcccatccttgattgttgtattgaccagattctgataacgttgcgtggcttcctggcgataatgattagtatgatgtgcttgatcataagtcagtagcgcacggattatccgtaaatcgtccaacgtagcgttgaccgcataccgcttcttggtacgtggatcataacgataactgaacaacccgttttcattaaaggtcgctttcgtctggcgatagaattgccgaaattgtgcccattggcgagtcgtaaccaggtactgtagccacatccccgatgactcactcaacatttcatgaccagtggccgttgcagtcgtccgtttacgcgtatctaaatagttcgtataaagcccttgcttcgtcaaaagtcctcgtttaataaatgccgctagttttacccgccgttgctttgacaccttagtcgcataggccgtcgtcgttacaaatccacttggcgcatgtcgtggtgtactaaccgtagtttgtttccgacacccactgacaactgcagtcagcatcactaacacgacaagccacccaaggtaacgcagacgtcctggacgtctattgtaaatccttgtcattttgcttggcccaatcgccataggccgtaattcgtgggtgattgcggcccgcctggcgttcttgttcaatcgcttgttgggcgacgaggttcagataattgaatggttcatcaaaattaggtgagaataacatatccacaaatgctagatcatcgatggtgtttccattttgaatcgcgattgataacgcattagcagactgtgccacttcatgcgcacttaagaactgagcaccgagaattttacgattttccggattataaattaattcaatcgtcagtttcgccgtacttggcatgtaagctggtcgccagttgccctcataagtcacccgttcagctggaatatgattcaatttcgccattgccagtgttaaccccgtggttgccagcgtgtgatcgaagagttgcatggccgatgtcgcttgagtccccatatatcgttgctggttaccaaaaacattggcccccgctaacgcaccctgccgaaccgcattggttgctaatggcgtataagccgaacgcccagttgggttgaagttaacgacacaagaatcaccagcagcgtaaatatctgggtcagaggtctgaacgtaatcattgatgataatggcaccgtgcttatccatctcaacttgaccgcgtaacagttccgtattgggaacaaacccagttccgacaattgctaaatcagcattaaaatcgccttgattggtttcaatgacaagttcaccatcatcattaccagtaaaggcagttacttggtgattcaatagcacgttcacgccatgatcttttaatagctgaactgcttggtctgaaatttctttactaatgtaattattcaaaatttgatcatgcgattggaataacgttacttcatgatgtgtattcgcataactttcagataattcggttccaatataacccgccacaatgattgcgatccgctgattgtcttgggctgtttggtaaatttcctgtgcttggctgtaggtcttgcataataggaccttagactcatcgattccaaaaatcggcgggaccgcaacatttgaaccagtcgtcataatcaatttatcataagtatcgccaaacacttttccagtagtcatgtcaaccacttgtaaggtcctcgactgggcgtcaatttttaacacgttatgtttggttctgaccattgcccccaacttggctaacgtttctggtgacgaatagaacatatcctccaagtgattgacctttcctccgagataaaggtagatcccacatgataagaatgaaatattgtcatcacgctcataaatcgtgaccgtagcctccggatgatccttcagaatttgtgcagccgcagcggtccccgcatgcgtacatccaacaattacaatcttcatttcattttgctcccaattataattttatttatttaaccataggtatattataaccgctttactgcgcaaatacataactctagtcaatataaatacaggttatgatgaaacataactacttttaaaaaccaatcagcgatacgctggcaagcagttattctcacaatatcgtccataccagctttgccaggtaaccactaattgactttttactcattttcagaaaattaccttgttcaccaagcagtttagcacaatcatcattagcccaattgataatcgataccatgcaaaaaaagatggtgtcaaacagtttcacttattcatttttggtatagtatgtattaggaagcatcaaatcgtgttaattcaagtctaaggagttcccttatgtaccgctattttattcagccccagttagataaatttaataattcactgattggctacgagatgctgattcgctatcgtgagactgatcaggaccggtggaccttaccagaaagcttcgataatattccgatcgatgtacaagtcagcttactaaaggctacggctagtgagcttgcattaaaaatcgggtcagtatcaattaactttaatcgcaagcaatttctaaatgatgatattgcttagccgcagtcattgatgctcagaaaaagctattcccggttcatgttatcgtcgaagtcacagaagaacccggtgaagatacgtttacactggcggcgatgcaacaacaaattgataagtacaaggctaacggcctacaatttagcattgatgacgttggcacgggaatcaacgtttacgaccacattaaaccgctactcgaatcggccgaagaaatcaaattcgccatgcaaaactttcgggccgaagatcgtgaaaacgagattcccattcaattaaaattctggcgcgacattgcggtacaacatgatatccggttaattctagagggtgttgaaaacgatgccgaagatcaaatggcgaatgacttaaatatttcactacgccaaggttattattatggcaagccccatttattcaaattaaaagccgaccactaggtgccagcttaattagtgaatcgcaattattcagcagttaactaaaaacaaccgtgaaattcttcttaatagatttcacggttgttttaattaatcaagtattatttagttggtttcttcgttgttttaggagcggcgctatcttctttagataacttagcaccaagatccttgatgtaagtccgcaagtcagccttaacatccggatgagttaacccgtattcgatcgtcgtcttcaagtagccaaacttgtagccaacatcgtgccgagtccccttaaattcatgggcaaagacccgctgagtcttgttcaacgtatcaatggcatccgtcaattgaatttcgtcacccttaccaggtttttggttttcaagaacatcaaaaatttctggtgttaataagtaacgaccaatgatagcaagatcactaggcgcatcttcaggtgatggcttttcaacaaagttattaacgttgtataggcccggttccttttcactttcaggattgatgaccccatacttagaaacttcctcatgaggaaccttcataacagctaacgttgacgcatgtgtcttgtcatagctattcattaactgtttggttaacggtactttgtcttccattaaatcatcaccaagcatgacgacgaaaggttcgtcaccaacgaaagctttagccgttaaaacggcatcgcccaaaccacgtggatgtgattgccggataaagtacaagttaatgtctgtggtttcttgaaccagcttgagcatttcttccttgtgcttagcccgtaagttatcctctaattctgggttagaatcatagtaatcttcaatactacgcttgctcttacccgtgacgataacaatgtcttcgatccccgatttacgagcttcgtcaacaatgaactgaatcgttggtttatcaacgattggtaacatttctttaggcatcgccttagtagcgtgcaaaaaccgtgttcctaatccggccgctgggataacggcttttctaacttttgacatgtgataaatcctcctaaaaatagtgaaattagtttggaaattcctactgaatctcaggtttcccctcgcgccgcatcaattgtggaatgacttccttaatgtcggcactcttatataatacatcataaatcgcttcagtgatgggcatttcgatattttgttgctgtgcaagctcgtaagcggctttagttgacgggataccttcaataaccatgcccatggtatcaatcaccgtcttgaggtcctgaccagcacctaactcattaccagcgcgccagttacgcgaatggacactagttgccgtaacaattaaatcgccaacaccggataaaccgataaatgtcaacggctctgcgcccaacgccactccgagccgactgatttcagctaaaccacgagtcattaaggctgccttggcgtcatcaccatagcccaggccgtgtagcgcaccagcacccagggcaatgatatttttgagcgccgcacctagttcaacaccaaccacgtcggtattcgtgtaaatgcggaaatagtcattccatgaagagttgctgtactaatttggctgcagattcatcggcgctagccgccgtaatcaacgtaatatcgtggcgggccacttcttcagcatgactagggcccgataagacaacgatcgcttgtcgtaattcggcgggaatttcttctgccaaaacttgcgacagccgcttgtgtgtctcttgttcgagtcccttgctagcatgcacaataatcggccgctgatgggtcttggcaagcacggcagtcacttgttgggccacttcgcgaatcgctttggttggtacgacaaacaagattacatccgcaccatcaatcgcctgtgttagattagaataagcagtcaacgtttctgaatatttaaaatcaggaacgtatcgctcattcgtgtgttgctcatttaattctgtgacttgggccggtgagtacgaccagagccgcactgagtggccattttcatccaacagatttgccaaaatgctaccccatgagccagcacctaaaacggcaatttttttcatcattcaaataaccctctaatctacttattttctgcgacaaccttttgaccagaaccagctaaataccaacgattattcggattgtgacgccggcgccagatcattaagccaatgctaccaaagaacagtaccactgacaacgcttgtgagacccgaataacgttaaatagcatgagcgagtcagtccgcatcccttctgtgaagaagcgaccaaaggcgtaccaagcaacataagtcaagaagacatcacccgcttataccaatgtgtgcgatgacgcgtgagcatcagtaaggcaaatcctaatagatcccataccgactcatacaagaatgttggttgccgatacgcgccacggatatacatctggttaatcagccaatcaggtaagtgcaagccttgtaagaaactcagactagtcactcgaccaaaagcctcctgattcataaagttaccccagcgaccaataccttggcccatgatcaccgttggtgcggcaatatcaagcattagccaagttgggataaagcgtgaccgacagaataaaatgaccacaattccggcgccaatcaagccaccatagatggcaattccaccatcccagatacggatgatttcaccgggattctgacgataatatgaccactggaaaatcacatagtaagtccgcgccgcaattaaagtaaacggaagtgcccataaaatcatatcgtaaatgtcatcgggccgaacaccccgtcgctgaccttcacgtactgctagtgcaaccgcaatgacgacggcactagcaataatgacgccgtaccaatggacctgaattggtcctaaccgcagtgcaattgggttaagtgcccctaaaacggtattcacgctactgccatctccttattacttgtgagaatcatgcacggaattcgttttgatcaacttgttcaagttatcgtcaaagaccttggtcgcatcgtagcccatgctctcggcaaacccgaaagttcatggccgctgcttcgataatgattgctaggttacgtccagtcttaactggaatcgagatttcaggaacttcaacatcaaagaatttccggttctgttctccatttcctagtctatcaaattgcttatcaggcgtccaattctcaaggtgcacgataaggtcaatgtcggtatcttgacgaacagccccagcgccaaaaagattcataacatcaataattccgatacctcgaatctccaataagtgattcaagattgcgggtgcttcaccgacaagcgtttgttcatcctgttgatagacatcgacccggtcatcagcaatcaaacgatgcccccgtttgactaattccagggccgtttcactcttcccaacaccggaatcaccagtaatcagcacacctaatccatagatgtcaactaataccccgtggacagattgtcgttcagctaatttaccttccaagtaattcgtcatattacttagaatccgtgatgatgatgtcattttcgttcctaaaatcggcacgccattttcctcaccggcttgcacgagttcttctggaacgggtaaccccgttgaaatgacgaacgcgggtgtggttaactgacacatcttacgaaaaatcatcagtcgttcatcatgactcatatttttcgaataagcggtttcagttttacctagcaattgcactcgttcacgaggatagtagttgaagtaaccggtcaacgccagccccggacgtgaaatgtcgctcgttgtaatatctttcttttctaataagtcagcgccatgatacacatccaggcgcgtatttttcaccaaatcggcaacggttacacttcccgccaaaagaatccctcctaattgttccactaataaaaagtgtggcccgcgttgtccagtcgcgccattacgctaccctttcaagcggccacacttttatgactgaaaacggattatttctatcttctaatcttagcactttaaagcgctttattcaccatcaacgccgtctttcgcgaaaaagttggaaacaatcacgttagcaattgacatgagaatcgaaacaaccatcgccatgccaaaactcgaaaagccgaaattggccttacccacaacgtaggatgtcatctgaagcataaaaccattgatgacaatactgaatagcccgagtgtcaataacgtaatcggtaacgataataacagcaaaaacggcttaatagcggcgtttaaaattgcaagcacaaaactggcaattaaagccatccacacacttgcaacgtgaaaactgctctgaaaaaagccagcaatcgcaataaataagattgtattgattaaaattcgtttccaaaagcccactgtataatcactccattaatcttagtgacgcggatcatcctcttcatgaacgttatgaatctctttgcgcccatgcgcttgcggtttagcttgagtaccggtactttgccgcatctgttcgaagaaacccgtattgtctggtttacttgggataattgtcattaatactaagtataccaaaacaccaaagccatgggtaaccaaggttaaaataacgtagagtactcgtagaatcgttgcattccagttcaaatattcagcaatgccccgaggacgccggcgaaaacgcgattattagatttagttaacttttgttttgtatttgatttcatcgttagacgctccttatcagtttatctaaccatatcttactaattgtaaaagccggttgcaaactagacgaccggctttaagcaattatttatgattagttacactaaattagaactttctggattcaattcgataatctcaccagtattcaaatacacgatccactcaccaatattagttactaacgccccgatgcgcattaggtaagttgcaacattcaggtaatccgtggaaccgatgaccgtctcaggatggcgctccatcttggagatccccttctcattaatacgatcatacagatctccccgacttttgcgtctttagctgcgacccggcgtgcttcctgatcatcacttttgacgtaagctgccaacatctcttcgaccatctttcgcacgcgattccccatttctgataacgctgcctcaatttcagggacgcgcacatttcctttgacccgaatcgtagcgtgagcaatattacgtgcataatcggccatccgttccaattcagagacggctttcaaaatggtgacaatttctcgcaaatcagaagtgacgggttggtataacgcaatcatctcaaatgatttctgttctagttcaacttcccgttggttgattttagcatcattatcaatgatttcttgtgcgaggtcgcggtcatggtcgataaacgccttgactgccttttcaatcgtctcgctaaccatcattcccatttcagtgaagtttgcatcaatatcgtttagttcatcatcaaaaagtcgtcgcatgtttttttcctcctaaccaaatcgttcctgaaatatagtcattggtttcctgtttaactggattcatgaaaatctgtttcgtgtcgttgacctcaattaattcaccattcaggaaaaacgccgttcggtcagaaattcgtgacgcctgttgcatgttatgcgtaacagttatgatagtgtaatcctggcgcaaattcaatagggtttcttcaatcatccgactcgatatcggatcaagtgcactagtggcctcgtctaaaaggataatatcaggttcgacggctaggacgcgtgcgatacaaacccgttgttgttgcccaccagacaatgatagcgcattggcatgcaaccggtccttaacttcatcccaaattgcagcccgcttcagactttttctaccgccgcgtctaagcgttctttatcatggactcccgccaaccgtaacccgtaaatgacattctcataaattgagaatggaaagggattcggctgttgaaacaccatgccgatctctttacgcaattgtaaccgtatcggtcgtgggcgcataaatattgtgaccattgaagttcacctcacccgtgatcgttacattaggaatcagatcgttcatccggttcaagcaacgtaaaaggtggatttaccacagccagagggcccaatcaaagccgtgattcctttatcatcaaaatcaatgttaattcctttgagggcctctttttaccataaaataatgataagttctcggtcgttaaaattgtactcatgaacggtcctcctatccaaagtttccggaaatatagtcattcgtcagatcaacctgaggattggtaaaaatctcaccggtctctgagtattctaggactttgccgaggttaaagaacgcggtatagtcgctaattcgcgatgcttgttgcatattatgcgtcacaataataatggtataattctgctttagttctaacaaagtatcttcaatttgacttgtcgatactggatccaaagcactcgctggttcatcgatgatgcagtaaaatgtctggcttgattgcaattgcccgagcaatacagagtcgttgttgctgcccgccagacagagctaacgcacttttatttaagtcatctttaacttggtcccacatcgccgcttgccgtaaagaccgttcaacaatttcatccaagtcttgtttcttgttcattccgcgctggcggagtgcaaaagcaatattctcatagattgatttggcaaacggattaggccgttgaaacaccatgccaatgtgccggcgcatctcatagacatcaatatcattactgttaatatctaagccgcgatacataattttgcccttaaccgttgcaatacggtcattcattcggtttagcgaacgcaagtaggttgactttccggaaccggatgggccaatcaacgcactaatcttataacgttcaaactgtaaatcgccctctgaaatagcctcggatttaccataaaagacgtgtaaatcctcagttgaaagcgcgatttcatgatctttaggatcaaacgccatgatgttacgttgtgtcgtcgtcattgtgttatctgccatcaaaacggcctcctttattcagcggttaagtgtttgtacaagcgtttgccaagccaacgagctaagaagttaaagagcaataccgcaataattaatacggctgaagcccccgccgaaacggctttcgcgtccggcataattccttctgagttgatcttccaaatatgaacggccaacgtttcggctggacgtagtggactgagtggactactgatatcaaatggattccagttaccaaagtccaaggctggtgcactttgacccgcagtgtagattaaagctgcggcttcaccaaagatccgcccggcactcaagacgacccccgttaaaatgcttggtaaggcagcgggaaccacgatcttcgtcaccgtctcccaacgtgatagccctaacgcgtagccggcctcccgttgattatctgagatattggcggagtgcttcctcaatactccgggttaaaatcggtaagttaaacacggtcagcgcaaacgccccggaaagaatcgagaagcctaacttgaactgcactacaaagaacaagtatccgaacagccccacgactacggatggcaatgaactcagaatttcaatggtcgtccgaatcaggccagtcaccgtattttgcggcgcatattcatttagatagatccccgcacccagtgaaatcggtaatgaaatcaataacgctaaaaatagtaagtagaaggagttaaacaactgaatgccaatcccaccacccgcttcaaaagccagggccggcgacgttaaaaatgccacgaaattttgggcaccccttggatcagaatgtatcccaatagggcaactaagatgatgaccacaaaggctgcgacgccgtatagcacgccagtggcaattttatcgatgcgtttagcgttcatggtttaatttcccctttcgaccaatgtagcagaatgactaagttaaagactaaggacatcaataacaggatcatggctaatgaccacaatgcattattttgtaatgaacccatgacagtgttcccgattcccatcgtcaagatacttgtcaaagttgcggctggtgaaactaggttatgcggcaacaacgtcgcgttcccgatcaccatttggaccgccagagcttccccaaaggcgcgggccatcccaaatacgacggcagtcagcatgccaggaatggctgcccgcgaggacgactttataaattgtttgccagcgcgtcgcccctagagctagcgaggcttctcggtaataacggggtaccgaattcagcgcatccgccgtcattgacgtcacggtcggtaagatcatgacaaatagcacaaaggtcccagaaagaatcccgtagccactacccccaaacgtattacgaacaaacggtacgacaacttgtagcccgataaatccatacactacggatggaataccaccaacctaatagttccgtaactggccggagaatcttcgcccccggcgtggtgaaatttcggtcataaagaccgccgtcccgatagcaaacggtgtggcaattaaggccgaaagaatcgtaatcaaaaacgacccaacaatcatcggtagtgcccccacagctggttgcccattcgttccgactgttccggggttccactgcgtcccactcagaaattgccatagattaatgtgattttgaaaaaggttgctaaccccgtgatgcaacaaagtagaaaatcaaaaagacaatcccgacaattagcgctagacaaactagactaatagccttaccacgccgttcaattttactagcaactgatttttttaataagctttctcgaattttatccatgcgctctccctcatttcataactgaaactttaccggccgcattccgctgtacttgcatgtcatggaccgaaatataacctaactgcttgactaacttctgctgaacagcggttgataaaatgtaatcaataaatttttggttaactgattggggtgcttccccgtatataaatgttcgtaggaccagatgtaccagcgattattccgcacatttttttcggttggccgaataccatcaacattgacggtctggactgatttgtctaagtaagaaaaagccacataactaattgcgccaggtgtactagcaacaattgaccgagctaatcctgacgaatcctgttcttgggaatcaacactctgattaccctttaaggcgtatcgctcaaatgtcttccgagttccggagccttgagcacggttaattaacgtgatcggtaaattacgtccaccaacttcacgccaattcgtgaccttgcccgtaaaaatctgaatgagttgctgctgcgtcaaattggtaatgcccgcctttttattaacgatgggggcaataccgacgacggctacccggtgatcaattaacttgctcgctgtaatgccagactgttcttcggggcaaaaatatcagaattaccgattgccacggcccccgcctgaatttgactgagtcccgttccagagccaccaccccgcacattgataaacacaccggtatggttgctgctgtattgttcaccggctgcttcaaccagtggctgtaaggccgttgatccaaccgcggtaattgattcactggcactagttcgatcacgatgtgtgtaccctaatccaactagtccaatgatcgcgattaacacgattaattggatgacccgactttttctcataactatatacctcctacccattgctcatattcaataatacaaagtttgtgtaaatgctttatatgagttttgtaaagattgtgtaaacgtcgatatatttttaattattaccggcttttagcccccaatatgaaaggaaaattaaaaaagtgcacaaaaaaacgattttcaaggtttacatttaccttaaaaatcgttatcaattcgtctggcttaattacgacacattttcaattctcaactaatgacatcttttgactcagcaatacaactcataccgtcaccacgtcatcatttgatagaccaccagttacaatcagaactgtccgtatgcttaacgccttactactgctcggaagcactcgcagctagtggcaatgtaactgtcatagttgtcccaacgccccgttgactgacaacgtcgattgttccgtgcattgcgttgaccaattcttgaacaatcgctaatccgagtccagtcccactcacaagttgctgtgaacgtgacggactcgcccgatagaagcgttcaaaaatacgctgttgatcatcggcactgataccaatgcccgtatctttaactatcagcgaccacgtttgatgactgaccatggtggcaatcgtcacgctaccatgaggtcgattatacttgattgcattcgttaacagatttttgatgatctgactcaacttctgtgaatcgctcgttatcattagatcagcatcgaacttggttattgatcgttaagtgctgacgttcgattgccctgctgaactacagccagttcctgttcgatcagtggtcgaacagcaagcggagctaaggttaacatcgtcgtattctgagcacgaattcgcgatagcgacagaacatcctgaatgagatcaatcaaccgttgactttcatccgcaataatatgcaagaattggtcaagcgtgtccggatcatccttggcaccacttaacaacgtttcagtgaaaccggaaatggctgtaatcggcgtcttcaactcgtggctagcgttgctgacaaaatcatcccgcatttgttcaatcatatagacttcagtgatatcatacaacatcaggacaatttgaaattgtgaacgattgccttggatataaacggttgaagcctcgacaactttgcgtgttaggcgctggggtcagcgtaatcgttgcccgttgatttttgccactagtaatcgtatcttcaatcaatttagtcaacgcgtacagctgaatatccttggtataaatgtgggccaccgtattaaccgagacttgcaatagttcactcatcgccggattagacagttgaacctgtcgccggtggtcaatgaccatcactcccacaggcaagtaccgcataatcatcattaactctttttcttgcagttccgcacggcgcgtctgactttttgataactctctaactggttgactgcttgtgctaggctgtataaggggtccgattgtggcaataagatatgtggtggaaattgctggctactcatctgacgaagcttagcttccatacggtcgatcgtgcgctgccgttcactttgttgccgccaagcgatcaagccctcgattactgccaaaaccagccaagcaccaactaaacaaccgactaggcgccaggaccacttaattggcgaaaagtgctgcaacacgaccaacacgatcaaaaccagtaacacattttccatgagcaataaccgtgtcgtctgttgccagcgattatgcatggccgtcacccacaaattcgtagccaaagccccggaccgtcctgatcaaccgtggctgcttgggatctgcttcaatcttttcacgtaaatgtgagatgtgaatatcaacgatccgcgtctcactagcatagtcgtagccccagacgtgatttaaaatcgcatcacgactgaggacccggccctctcgttcaacaaaatacacgagtaattcaaattcctttggtgtcaaactgatatttttcccgttgcgcgcgacccggtatttgttttgatcaatctgtaaatcaccaacaagcattaccgcacgattagcaggcggcatgggtgccggtggtgtcacgggctcgtccggcgttgtccgccgaataactgctttgatccgagcgagcacttcgcggggtgaaaacggcttggttatataatcgtccgcacctaattccaagccgaacactttatcaaactcatcatttttagccgtctcacaataataataggcgtctgaaccttttcttgtcgtaactttttgttacttccattccatcgagtttcggcaacatcaaatctaataaaatacatgtaaatgattgggccaggcctaatgacaacgcgtccgcaccatccgtcgccgtcacaacttcgtaccccgcccgcttcaagttatatgataataacgtgacgatagctggttcgtcgtctaccactaaaatcttatccatggtcattaatcctcctgatcagtgaataacacaattcctaactcgtgtggggcgccattatagatcgccgtttcggtaataattaattcctgttgccgattgcgcactttaaggtgaacatacgtcggacttttcagtagggccgcgtaaaattcagcttccgtattaactggttgccggttacattccaagacaatatctcctaaatcgagatttaatttatccgcgggcgtgtggggcgtaacccaatcacccgcacacctttgttcagtatcagaatatcgaaactgttggtgtcgatcgtgataacggtgctgtgctaagattccccaagttagcacaacgattaatcccatcaatgctagcaaccactgcgggctgagcactgcaaaacgggcaatgattgcaaccaaaacactcgcgagtgttacccaaccatagcgggccgctaactgccgccatgcaatttgtggcagctgcttataaacgcgaacactcgtcccaactaataaaggcaacaataaaatgctgaaggagcgctcgccaaccataaacacaggccaccaactgatagttgcgtgtaaccaatcaccggggaccagtactccaactggtaagaccaacaattgttgccactggtaacgaacaagtcgctttccacgttggtcgggctgtagttgcggtgaacggccctcataatcatagtgtcgtaacaagaccgccgtagctgccagcacgatggctaataacaatagtccgttcaccccaccaaattgccactcatactggtcatggcaacaccgtgccgttgtaaagcgcccccaccgtcgttaattccgggctcataatccaataaactaaccagctgaggccaaaagcggtcactggtaccagtgcaccaggaataatgatcaagctaatggccgccactacttcgtatataaccacccagatgggggccaccactaatcccaatgccaagctaataattgtcattagaactcctagtaaacagccatccactaaaaagtggtggacttcaactaattgtgggttgatagcactctgaaaatgctgccgttcactcttcacccgccgtttagcggttaaataactacgcagcaatcctaaccaaactagcggttgtaaaagaaacaattcaaaaatctttaataccgcatgtgcgtgacccctaacgttaaactctgaagttagtatagcatttttgcccaaggagaccaacgccgtttcaattccgtcagtctcaccgctattaccgctttaatatctctatattataagactagtagccaaaaaaatactaagacgacacgcgcaatgataggtcaccttagtatttgtgcaatctattgcggattacgttgggctaatttccattgtaagtaagcatccataaacggatcaagatcaccatccatgacagcccgcccatcatgtgattcataattagtccggtgatccttgaccatcgtatacggatgaaaaacgtaagagcgaatttgtgagccccacccaatgtccatttgctcaccttggatggccgcccgttccttagccttcttctcttcttcacgttcgtacaacttcgctcgtaacatgttcaatgctgtttgtcggttctgtaattgtgaccgttgcgcttgactggcaacgacgattcccgttggcacgtgggtaatccgaaccgctgaagaagtcttattgacatgttgtccaccggccccactggctcgataaacgtcgaatcttcaaatcttcaggtcgaatatcaacatccacggtatcatctaactcaggcatcacatcaacactcgcaaaagatgtgtggcgccgaccagccgcatcgaacggcgaaatccgaacaagacgatgaacccctttttctgaccgcaaataaccgtaagcattgtggccgctaattaataaagtcacactcttaatgcccgcctcatcaccagcttggtagtcaacagtctcgactttgaaattgtgactcgcagcccagcgcgtgtacattcttagtagcatcgcaccccaatcttgggattcggtcccaccagctccaggatggatttctaaaatagcgttattgcggtcgtacggaccgtccaaaagtaagttgagccggtactgttgtaaatcatgttcagcgtgctgaaagtccgtttcaaactcagcccgcatctcagcatcgggttcctcactcagtaactcataagcgactgccaagtcaccgacttcacctcagctaattgcttaaacgtatcatactttcctttcaacacgttattctcatcgataactttctgggcggcagcctggtcgtcccaaaaaccgggttcggccattcgagcttcattttcttgaatgctttcgttcaaagcatctaagtcaaagcgacccctaaagtcgtcaacagcactttgcatttcctcaatcaggtgtttatattcacttaattccacaaaggacccttctttcaacttatttattaattatttaatatctagtttaactgtaaaacgagcctaagaccttagtcttagactcgctagcactaacgttaaattttaacgctgaatattttggcgaatttcagacttcatgaagagtcgcgtcgtatcataatcaatatccgcaaccatttcttcaaacatctggtaaccgtctcgttgatattcaactaacggattcaattgaccatagccccgtaaaccgatcgattgccgtaattgatccatcgcgcatcaatgtgatccgtccaatgagaatcgaccactcgcagaataacgactttttcaaattctagcatctgacccgcatcgtaaagctgtttagccttgtccgcataaatcttatcgacccggtccatcaagtaagcttcaacctctgctggcgacttacctttcaagtcagccacactaattgaatcttccttcaccatagcagcttgggcaaagtcaacaactgcatctaaatcccagtccttggcatcgccttgcatgtgtaactgaacggtccgttcaacggtccgcttgatcattggcatgataacgggctttaaagatttttcttccataatgacttgttgccgctcgccgtaaatcacttcacgctgagcccgcataacatcatcatattgtagaacgttcttccgggagtcatagttgttcccttcaacccgtttttgagcggactcaacctgtcgagtaatcatccgtgattgaataaccgcatcatcatcttcaacattcatccgttgcgggaagttcttgattcgttctgaaccgaaccgtagcatcaaatcgtcttcaagtgagaggtagaattgtgacataccaggatcaccttgacgaccagcacggccccgcaattggttatcgatccggcgggactcatgacgttcagtcccaataacggcgagcccccgacttctttgacaccaggtcccaacttgatatcggtccccgaccagccatgttggtggcaatggtaaccgcaccacgttgaccggcgtttgcaacaatgtcagcttccttcgcatggttcttggcgttcaagaccacgtgcggaatgttttcctcatccaaacgatgcgacaagtattctgacgtttccacggcaacggtcccaattaacattggttggcccttttcatggagttgtttgatttctttaacgaccgcgttgaatttgctttgtaacgttgggtaaagcaaatctgaacggtcatcacgaatcgcatcgggcggtttgttggaatcgtaataacttccatgttatagatttcgcggaattcttcttgttccgtcttggccgtcccagtcatcccagataactttttgtacatccggaataagttttggtacgtgatattcgccatcgtcttggtttcttcttgaatctcaacgtgttccttagcttcaattgcttggtgtaacccgtctgagaagcgccgaccatccatgatccgccccgtaaaggaatcaacgatcaacgcctgaccgtctgaaatcacgtagtctttatctttcaacatgatgtagttcgcacgcaaagcttcatccaagtaatggttcaacgccgtattatcagtatcgtaaaggttttccaagccaaagtatttttcagctttccgaatcccttcgtctaataatgcgaccgtcttagattccaagtcaaccttgtaatcttcatccttcgtcaacgtcttagcaaaacggtcagcccgcttatacatatccttcccgttgtaccttctgattgaccagaaatgatcaacggtgtccgggcttcatcaatcaggattgagtcaacttcatcaatgatggcaaaattaagtggtcgttgcaccatgtcttcacggtagaccaccatgttatcacgtaagtagtcgaacccaatttcaccgttcgtcgaataagtaatatcggcgttataagcggcacgtttttcttcaggcgacttttcagccccgttgattccgacactcatccctaaccagttatacagttcacccatttcagtcgcatcacgcgctgataagtattcattaactgttacaacgtgaacacccttaccagagatggcattcaaataaactggcatagtggccgttaaggtcttcccttcaccagtcttcatttcagcaatgtcaccttgatgcaaaacgattccaccgaggatttgaacgtggaatgggtataaaccaagtacccgcttcgcaccttcacgcgccgttgcaaatgcttcgggcagcaaatcgtcgagcgattcgccctccttgtaccgttcacgaaattctggggtcttcgcttgcaagtcagcatcacttaacttgccgtattcgtcggcataagcttcaactttattagcaatcttatccagacgccgaatagtccgcttgtcgctttcaacccagcgttttaaaatgttggccatttacgtatcctctccaaataattaatcttaattttaatttcaattgtccatttcaaaataaaataccatctgtcattttaccattatttactagcaatgaaaaccacaggcccctatgtaaccgataccgtcgaccgttttatttacatccttaactaaatattagtctttaaccacagcccaacaatcactgacccgtgttctttaattctatcaatatttgcttaactgtcttgagtcgctggcaaaaacgtgccgtgagtcgaacttcagcttactaacgcgggctaagtcacatctcatgatcacaatatgttatacgggcgttccgggataaaaataaagaactggtcaactgaccagtcctcataagttgcgcttttaaaattagtgattgtcgtcggtttcaatcaaaccgtaacgaccatcgttacgccgatagacgatgttaattgcgtccgtttccgcgtcttcgtagataaagaagtcatggccgagcatatccatttgcagaatcgcttcttcattatccattggctttaaagccactcgcttcgtacgtacaacgtctaacttatcgtcctgatcattgtcggcagcggcaactgtttcatcagtcgctgcaaaatcaatcgctttataacccttttcacgggatttgcggttaaccttagttttatacttgcggatttggcgttccaacttgtcagtaaccaaatcaacactagcatacatatcaggagaagtttcttctgcccggagaactaaatagggaagtggaatggtgacttcgactcttttagccgtcttgtctgggtgaacttttaagttgacatgggcaattgagtcaacattattgtcaaagtacttctgtaacttacccacccgtttttgaacgtagtcccgaattgcttgggtcacttcgatattttcaccgcgaatattaaaatttagcatagatcttctctcccttcacacacattgctgtgtacccaaagtaattaaaggaccactctttaattactttgcttaaattcattataatagaaagcgctataataaacaatccaaataccactttccctcgaaattaacgtgctagtgttagccccgtcacgctcttggcaccgttttccaaaagtagcgttgccgcgtggcgcatcgttcggccggtagtatagatgtcatctactaataatacccgccggccggccaaaatcgtattaggagccatcttgaatggttgtggtgttctcaaccgctcttgccggtctttcttagattgtggcactgacttcgcctgttgcctgggtcattaacccgggtgcggggtgcggctaaccagccggcaacttgattaaagccccgtgtttgcaacgttgtgggcgtgacaggtaccactaagcatatctcagcacaccgttgtaccactgcttgttgcatgatcttcgcaaaaacttggcgtaattgataatcaccctgaaatttatagcgttgaaaataatcatgcatcgcatcattatattcgaacaacgcctcgttatgaaagggaccgatttcaggccaccgctgacaatctgtacacggttgtggtcgtttttgagcacgtccacatttggaacatgccgttgcccgatcgatgcgtacaaattgccgccaacaaaccgagcagatgaccggccgcataaccggctgccaactaagaatccagggcaacgtaaacttagtcgtgataatgttgtgacacagtaggcatgctagcacgtaattgtcgcccctttcgattgatcacccgagccaatctggcgctgagcgcgtttgatattgcggctatgactgtgacaaataaaccagacgaggccagtcggacgctcactgctgcgtccgacccgtcccgcaatctggacgagggccgccgtagaaaacacttcgtcgtccgcaccaagcacaatcacatcgattcccggaaacgtcacccctcgttccaatatcgtcgtcgtaactaagtattgaaactgctggttccgcatttgttgaaccttagtcagtcgctcaggatcggctgagtacaccgtctctccggtcatatggggaaaatagtgttggagtaccgcaaacactggcgctaattgttggatgcgcgggacaaatagtaaaaagcgctggtgctgttgttgatactgttggagttgccggataaggtctcgtggtaattttccttgttgcaacagccgagcccaatttggctgtagcttaaccttaattgccagtaataaatgttggtgaaaccgcaatggtataataactgattgcaagctcaccacgatgaacttgggacaacaaactttggctgggcgtcgcggtcaaataaagaatggccccctccaccttagctgcctgattcactgcaaacgccaaacggggattggcagcaaacggaaacgcgtcaacttcatcaatgatcaatacgtcaaacgcctgacgaaaacgtagcaattgatgcgtcgtacaaatcgtcagctgcgtatactgatagggatcgggattgcggccatgtagcacagcaatttgaacatcagcaaaggccgcctggagccggggtgctaactctaagcaaacatcgactcgtggtgaagcaatggcgacccgccactgatgcgctaacgcccacgcaatacctggaaacagcatttcagtttttccagctcccgtcaccgcccataataattgccgtttatgcgccatgaagttagctttgattgattgcgcgcagtccgcttgctggggcgttagggttccttgccacgtgcaaaccgggaccgttgcaaaagcattcggttctggcatatgatagagtttaactagtgtactcactcgacctaaatttaaacattgataacagtaatattgctgattgggtaattgggctcgcagtcggtccaagtgactgccgcaacgctgacagataatttgatgttcatcaacctgcatggctggcagtatctgcgtgccagcggtactgcggcagcctcatttgcagataatgcgagctgacgaccgtataagacttgtgcttccattgtgcgcacctccttagttatcaagtacgccatttaacgatttattcacgaaaggaaccgattaatttgactaaaccctactacaccatcacccaagacacggtatttgaacaaaccatcaaaaagtctcgcttcatcgctcatctataccgcatcagtgacgaagtggatgctcaagctaagattgccgctgttcgagcagataatcctaaggccaaccacaactgtttcgcctacatgcttggtgatgatgatcatattcagcggatgagtgatgacggtgaaccagtcggaactgcgggctcaccaatcttagaagtgctcaagaccaacgacctacacgacgtgcttgcggtcgtgacccgttattttggtggtatcaagcttggcgccggtggactgatccgagcttataatggcacccccgcgcaagcaattgaagtcagtggtaaggttcagcgaatcttacaaacccgcatcgccatcacgctcgactatcgtaacgtcgatgctttaacctactatttacaacaaaataagctaacgaccctgaataccgactacggtgttcaagtcacacaaatcatcgcagtcactcaatccgaaattgcaacgattcagcaggacatcactaacctcttgagcggtcaagttaccttttcggagcaaggtgaacaatttacagaaattccggtcactacgcctggcaactagattgctggttatatataattgggagcctcacaaactttgattggcagtcaaaatcgaaacagccaactcgtcttaacaataacacccagcacttgagccgatgatttgtttttcattgttaaagtccgcgttgcactaattgcggcccataaaaaaagtcgagctatcgctcgactttttgtctgttatttattttaaattagtgattgcaccagattggccacgatcaaccttcatcgaagtcaatggaatatatcctaatttctcaactaaactaccttgaacggctttagaagtcatgtaagttaagaagttcttcaactccccagttggttgccccttagtatacatgtgttcataagcccaaatcttccacttgttcgtcgctacgttagcttcggttggtttgacgttatcaatagaaagcgcctgaacgtcactcttaacgtatgagaatgctaagtaactgatggcaccaggcgtggtgctaacaattttttgaacgggtcccattcgaatcttgttcttggctagttgcgaccttcgcgttgtctaatccccatttttcaaacgtcgcccgggtcccactaccttgagcacggttaacgacggtaatcttttcgtccttaccgccaacatctttccagttagtgatcttgccttggaaaatcttgataagttgttcttttgaaatattagtgacaccggcatccttattaataacgggtgccatccccacaacagccactttatggtcaactaaccctttggcgtctaaccccttttgttcctgtgcaaataaatcagagttcccaatattgactgaacccttcgccacctgacttaagcctgctcctgaaccaccaccctgaacgttaatggtcacgttagcatgttcgttctggtaagcctgtccagcctgttccactaatggttgtaaagcggttgaaccagttgcaacgatcttagtagtcttggaactaccactactgctactagtactcttcgtcgtacttgtggctgagctactgccgcaaccagctagtaaaatggtcatcgttactgccaatgcgccgagtgtcagtgctttttcataattgaaactccccttcttcaattgactatcaaaattaagcaaccaacccggcaaccatcatagcaaaactgggtaggagtgctacgactagtgatggagcaacatcaccgtccgacggttacacgtaattgattgcttcggaacatgcttaatattactaatcgtttgtaaattgtgaatgacgattgtgtaaattgcttgtatagttttggtaaagttaagattgatgaaccaactgatgaccaactaaaaacaggcatcaccgctaatcacacggtagatgcctgtaacactttaataattttcaatgatttatttggtttttaatgattactcttggaggtcaaatgcgcgacggtccgtttgatccaatccagtagcggttgccgattgtcaccagctaatccgattgagccttcaacgaataactctagcccaaataataaaccaatcgtcaataacacagaaccccaaatagatgagatcggatagagcaatgaaataaatgagaaaataagtgcaatcccataaattaccatcacagtctgtcgatgggtcaatcctaattgcatcaagcggtggtgcaaatgatgcttatccgcttgcgaaatgggcttcttattcaggatccgtcgaatcatcgcatacaccgtatccgtaattggcactcccaggatcataaccggaataccaactgagattaaggtgacatttttcaatccaaataatgagaacacagccgtcataaagccgataaacaacgaaccggtatcaccgagataaattctagctggaaagaaattatacggaagaaagccaatcatcgccgcaactaaagtaaaaatcaacaacgaaacgaacatattagcattcaagaagaacaacccgatgattcccatggtactcaacgaaaataatcgaaacaccggtagctagcccatccagtccatcaattaagttcaccgcgttcgtgatagccagtatccacagtaaagtcaccggtaaactcagccactgaaagtgaatcagccccagcaacgggaacgtgaaggtcgtcattcggataccaccaataaagtagacctccaaagcggctaacgtaatccctaacatttttgccgtggttttagctcataaatatcatcgataacaccagtcgcaataatgatcagctcaccaccgagtagtgcgaaaaaaatgcgactgggaaactggtgcatgagatacaacacagtcgtcccaacggtgtaagagataaaaatagccaagcctcccattgtcggcattggaattttattgacccgtcgtacatttggtttatccacggcaccaattttaaatgcaagtttccgcacaaacggcgtcaagatcgcagaaagtatcatggtcgccactaggcttactaggatttcaaatctgatcatttgtgcgtaactcccttctcactctattacgataattatacaaatcccagtgacgcttgacaactcgcttcactaaaacttagtaaaggcaacacaattcgttcacatttgccggtcactgggctgattaagtatctaaattataaccttagttactcatattatgacacaaaaataaaagaggctgtgacataactagcctctgtataagcaaatgggacgagaaaccgaattttggtttctcgtcccatttgcttacgcctttgatttttaaagttggtccctaccgtgaccagtttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgaccagtttctggagctgaaagtaattctcgttgtttcgatttgaaatattcccaattttcgttcacggaaatccttttaagatatccttttggtgttagtgccgcggcaattagttgatgattttcatcatacttttcggcaatgtattctttaaagtcacgggtaaaaccatacttatcagtccgtcgacgataagcattaaaattaaaccggacgttttgcggattgataaaataatcatctttttcatgatagtcccagttcataaccttacggtcatcactttgccattttcgactattctctttaagcattgtgccgtagggaatcaaaacggtatgctgaccgaattcatcttccaagtaccgataattactttcggaaccgtatacggcatcggtaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcgggttttaattgaccgttttgcatcggatcttccttgacccgcataaaggtggcatcgtgatccgtcttagagtagctgttacgctgaccatagattgcttgctgtgcttggtgttcacgcattttatcacgtcgtttatccaacttacgtttttgtgatttaacagtccggcgttgctgtttggctgggttcggggaaacccgcttagttgcttccacggtttcattaaggaccactaagtgatcctcaaccttgctaatcatgatatccaatagttcgggagtcagctctgatcccgccggaatttcaccgacaattttagcttcatgaagctcgcctaacaggtcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagctatcggttgtcaaagtggccagttcatcagaaattctaaagcgacaaatcgtccggtaggacggaatttggtcggcaattaaccacccagctggcttgttttcacgggcaaactgttcaattttacgactgctgaaaatgccatagctgtacgctaaaaggaccaattttaacatggcaccgaggttatattcccgcggacggccaaactggtaatcatattttagttttaaactctcaacaagctggttgatgtaacgagcagaatgatgctcttctggttggtaatccaaggcgatactcaaagtggtttgattcatgttataataatcttgcatattaggaatgtcctttcgaggataatttcgtagagtatcgggtgcgaccgatgctcttttttattttctattatatcaaaagcgggtctggaaaaattcgaagatttttccagacccgctttgtttctagagacttatgtcacagcctcttcaatactaagtcactattcttttaaatggtaattataagttgaaacaataatattttcacgagaatttaataccgctcgtaatcggagactcgtttgattatgcaaaatattctgccatggtttcttcggcacgaattgtgggacaagaaccgttgtcgagaagttgcgttccgctgctcgtttagcaatcacatcgcagaatcgtaacgtcggtgttgcaatcgaccgatacgacgaatggatgtccacgaaacggacgtctgggaaggtctctttgaactctgccgccgtcttgtgttccttttcagggttctcatcaaaggacacgtgcatcgcaatgacgtaatctccgatggatcgcgcgtagttgactgcttgagcagttacccgcgtcacattcgagacgaggacgatcaccgttgcaccgtcataatcatgaatcgccgctttttccttggcaaccacgcgtaactgggccgcaacccggttatagtgcacgtggatttcggtagaacatgtacagtaagagtggcataacgattaagtatggccaaacattgccgaaatgtagcaagaataggaaaatcactaggagaatcgaaatcaacgccccaagtaagtttaccgccgccttcatccaccaccattgcccccgttcgcggaaccaatgaataatcataccagattgcgacaaagtaaatgggacaaagaccccaccgcataaagtggaatcaaaagcgtcgtcttcccatgaaagataaagatcaacgcaattgccccgaccgccaatgagataatcccattgagtagcccaagcggtccccacgatccatgtaagcatgtggtagaaatttatctttagccaagttataagctaaaattggaaaggctgaaaaaccagtatttgccgcaacggccagaattaacgccgtcgataattgtaacaagtagtagaataagccgtgaccaaagaccgccgtagcaatttgtgacaagacggtattgtctctacttgtggtttaacgcctaagtaataacttaaataagtaataccaccaaagaagacggccaagactaatgacataattgctaacgtgttcgccgcattcttgcgtttcggtcgtttgaagtttggcaccgcattactgattgcttccaccccagtcagcgaagacgaaccggaagaaaaggcccgtaagaacagcaccaaggtcatcccttgaaccggtgctccaactgctgcggaggcgtggtaagttaagttaccactcgcaatattcataacgccccatagaatcatgccgataatcataataatgaaaaaataaacgggaaacgttaagaatgatgcggattcgcgcattccacgcaaatttaacgccatgatggcgatgacaatcagtacggcaatcaatacttgataattagctagcgccggaatcgccgacgtgattgcttcagtaccagaagtgacggaaaccgctacggtcagcatataatcaaccagcagtgatccccggcaactaatccggctggccgcccccagttcgtacttgccaccacgtaggcgccaccgccagatggataagcccgaataatttgtcggtacgacatcgtaatagcaaacaacagcactaacacaagcgccgccacgtacaattgatacatcaacgcggccgctgaaagtgtaatcaaaacggtcgtaatctgttcagtaccgtaagccaccgatgatagcgcatctgacgatagcagcgccagtgccttgaacttggtgagtgcttgcccaccctcgtccatggtttttaacggtttcccaataactaaccgctttaaataacgccacatgataataactcctttattccaaaataattatcccaaagtaaactgagtcaaagtagattctactactttaccccgccaaatactaccagttaaatgtcgggtgcttcaccgcacccacattttgcgttaacgactaatcctaccgctctaatatgctgggataaatcaatacctttattctagtcgattcacaccctaacagcactaaaaagcacttactcagccgagtaagtgcttaatgttacgatttgtttacatcataccgcccatacctgggtttggtgcggctggtgcattttcttcaggtttttcagcgacaacggcttcagtcgttaagagaagggctgaaacagaagcggcattttgtaaagcagaacgcgttaccttagttgggtccacgataccagctttgatcatgtcaacccattcatcagttgcggcgttgaaaccaacacctggcttttgttccttcatcttttcaacgataacagagccttccaaaccagcattttcagcgatttggcgaactggttcttccaaagcacgtttaacaatgttgatcccagtttgaacgtcaccagtttccttcaatgcagcaacatctttgataacgttaatcaaagcagtaccaccaccagcaacaaagccttcttcaactaacggcggcccgagttgcgttcaaagcatcttcaatccggtatttacgttccttcaattcagtttcagtagcggcaccgacacgaacaacggcaaccccaccagctaatttagctaaacgttcttgtaacttttctttgtcaaagtcagaagttgtttcaccgatttggttacggataaattcaacccgttctgagatagcatccttggaaccagcgccttcaacaatggtggtgttatccttagtaaccgtaactttgttggcttgacctaattgatcgatggtcgtgtccttcaattcaaggccaaggtcgtcagtgataaccgtcccgccagttaagatagcgatatcttgtaattgttccttacgccgatcaccaaaaccgggtgccttaacggcgacaacgttaaacgtcccacgcatcttgttcaagactaaggttggtaaagcttcaccagaaatgtcatcagcaatgatcaacaatggcttgccttgttcaacgatttggattgtaatagtggtaagatatcttgaatgtttgaaatcttcttatcagtaattaagatatatggattgtcaagatccgcttccatcttatcattatcagtaaccatgtattgtgataagtagccgcggtcgaattgcatcccttcaacaacgtctaaactagtatcaacaccacgtgattcttcaatcgtgataacaccgtcatgaccaactttttccatggcttcggcaatcaatttaccagtttcttcacttgctgaagatacagaagcgatttgcgcaatatcttcttgcgtcttaacttcgtgtgccatagcgtgtaatgagtcaaccgccgtcttagtagcttcttcaatcccacgacgaatgccaacagggttagcaccggccgtaacgttcttcataccttcattaacgattgattgtgttaagaccgttgcagtagtcgtcccatcaccagcgatgtcattagtctttgaagcaacttcagaaactaaacttagcacccatgttttcgaaatgatcgtctaattcgatcgccttagcaatcgttacaccatcattagtaattgttggtgaaccatatgattgttccaaaacaacgttgcgacccttaggacctaacgttgacttaactgtgtcagctaattgatcgacaccttttagcatcgctgaacgtgcatcttcagagaactttaattctttagccattatctctattcacctcatgaatttaatttattttaagttgcgcaatttaaatggattagtcttcgattgcaacgatatctttttcgtgcaataccaaatacttagcaccttgatacttgacttcggtaccggcatacttatcgaataatacttgatcgccgaccttcacgctggggtcaacttttgtcccgttatctaaaacacgaccgtcattgacggcaacaaccttaccgctttggggcttttccttagcgttattggcaatgacaataccgccaattgttttgttcttcttcttcttgttgttgcaagataacgcgatctcctaatggttttaacacgtgaatccctccatttattctttttagcactcctcaacctcaagtgctaattacattgtcaactatatcattttaattcaagattgcaagtgatttgtcaattattagtcaaagaatgtcaaatcgactataatgaatactattgaagtatcaataaatcttaaatcaaacttttaaaaggacgtgacttgatggttaatcgccgccaatcaatctttattcttatcatctactttattatttacgcactaccgagcgtccttgtgactgctttccatcagctaggggcccaagtattcgtgattcaaacggtcgactacttagtcggtgcaatcctactcatctggttggcgagtcgcatgcggacaaaaacgttgttgaaaaacaaccaagtaactggttcatgacgttcatctggggattgatcggtcttgtcctagtccaatcgttggtcaagtcatcattttaaaaatgacggctttactgggacagtcaacagcgtcaaccaacacgaccaccctcttaactgttgggcaacaatatcccgctttcttcttagccatcattgtcggtgccccgattatggaagaaatcgtcttccgcaaagttatctttggcaatctaagtgcggttactggtcagattggggcggccttgatttctagtgtgctatttagctttgcacatgcggatggtcactttatcctctatgcctttatcgggttattattctgctggttataccagcacaccggtcggattcaaacatcgatgacggctcacatcctaatgaacgcatcggttgtgttacccacattattaggcttactgcactagtatcattactaggtagcgctaacctagcgtttcaacgttaattttcaccgaatatttatacgttacaatcaatgattcgtgatctaagtatgttaaaaaggctttcctgaataattcagagaagcctttttatagccatttaatttcaaagataaagcgagttattaatcttcagtctcattttcatcgtcattaccattgtcacctaattgctgaccgtaatgttcaatgaagtagatcaatgtttgtaattcgttggtcaaatcaacgttctgaacccgtactgtctcaggaacggagattcgtaacggcgtaaagttcatgattcctttgacgtttgcatcaaccaagtcatcggtaattttctgaacaaccgtggttggcaccgttaagatagcaatctcaatctgttgttcgatcaattgctttttgagctccgtcattgggtacactggaaccccactttggactgtattggcaatcgcctcgttgacatcaaatgctgctgaaatgcggacattactgtttttgtgaaaattaaagttcagtagggcgtggcccaaattaccgaccccaattaaagcaacattcgttaaggtgtcttgatttaaaatcttttgaaaaatgcaagtaacgtttcaacatcgtatccataccctcgtttgccgagcgccccaaaatacgagaaatctcgccgaatcgttgctgaatctactttaaccgcctcggacaactcggtcgatgagacccgcttcttatctgcatctagcaagatatttaaatagcggtaataaatcggtaaccgttttgccgttgcccgtggaatttttgtttctgccattcggacgtgtcctcctaattaaaagtttgtgaatttgctgacactattctagcataacgcgtgactttgtgaaataataattacttattattccgaataattgggtcaggccgttacaatatgctacaattatgtcacgaattaaatgtgaaaggagcttaataaagcgtgattttactacaagtacagcaagttatgcggcgttttggcgccgatgtcttgttcgataacgtacaaatggatattcaagaacacgctcgggccctggccctcgtcggtcgaaacggggccggaaaatcaaccttacttaaaatgattgccggcgaaacggtaccggacgaaggccagatttcaatgcgcaagggcttaacaatcggttacttggcgcaagaccaaggactggatagtaacaatacgatttgggaagaaatgagtagtgtctttgctgagttacatgccatcgaaaaacggatgcaccagctcgaaaatcaattgagcgaccccgcaatcatgaatgatgagcgggcttatcaacagaccctgaaaacctatgatcagattcaaactgaatttcaacaaaaaaacgggtacggctaccaagctgagattcggggcgtgttgcacggcttccaattcgacgccgatgtgtacgataagtcggtgacggcactatccggtggacaaaagacccagttggccttggccaagttgttacttgaaaaacgggacttgcttatccttgacgaaccgacgaaccacttggacgtcgaaactcttacttggttggaaagctatctccagtcttactctggtgcgctgctaatcgttagccatgaccgttatttcttagaccgggtcgttaacgaagtctatgacttatcacaccatgaaatggtgcactacactggtaactacgaccagtttgtgcaagaaaaagcggctcgaatccaagcacaatggaaacattatgaaaagcaacaagcggagatcagcaagcttgaagactttgttaatcgtaacatcgtgcgtgcttctacgacaaaacgggcccaggctcggcgtaagcagttagcaaagatggaccgccttgaccgccctgatagtgacgagaagactgcccactttggctttcatgcggctaaacaaagcggcaacattgtgttgaccgtcaaagatgcagccgtgggctatgatggtcagattctttcggaacccgacaacttgaatattaagaaacatgaagctattgccattgttggaccgaccaaacggtattggaaaatcgactttcctaaagagtattttgggacagattccattcattaaaggccaggccgttttggcaccaacgtcgttacgggctactacgatcaagagcaacgtaatttaaacgacaaaaaaaccgtcctcagtgaactttgggatgaacatcccaccactcctgaaaaagacattcgtaccattttgggcagttttctcttcactggtgaagatgttgataaacccgttcatgccctatctggtggagaacgagcccggttactgttgaccaaacttgccatgcaaaatgacaacttcttaatcttagatgaaccaactaaccacttggatatcgatagccgtgaagttttggaagtcgccctcaacgactttgacggcacccttttgttcgtgtcacatgaccgctacttcattaaccaagtcgccacgagtgtcgtagaggtttctccggaaggcacggaactcttcttaggtgattacgactacctacatcgacaagaaacaagagcaagctgaaatcgcggctgcggctgctagccaagcggccgaaaaagctgctgaagccggtgcagcggattcaaccagtgccacaactgctgctccccgctccaaaggccagcaaaattaccaagccagcaagcagcaacaacgtgaaaagcgcaagctcgagcgctcagttgccgccctggaagaacagatgactgccttagatgaacaagccacacagattcaaactgaaatggcgcaacctgaagtatcggccgatgttggtaaactacaagacctacaaaaagaacttgaagccatcaatactcaacaagaacaagttgaaaccgaatggaccgaacaagctgaagctttagaagaattgagctaattttccaatgactcatcagataaaaataatagtcgcctcaagaattaatataattcttgaggcgactattattttgcccctatccgcggcataaatcatgattgaaagaaggatgattcctagaatcaaaaatgaccagcttaagcccgctggaaacagttcaagttagtgtaaacttgcttagttagttcgtcctacaccgacctccagtcgggatagcgttcgaatggctgacaaggatatacccaacttttgctgaatttgtcgttgtttttcataaacgttaattttatcaatcaactgtcagattgaaaaggtcttgtgataactcactatttctgaattaccgtagtaataattgaatatttcgaaaaagtggagaaggcactctgatatttaacttaaagggttcagtatcaaaatagccaacgacaaattgtactgagttcagtggccgttcatcagccattcgagcggcttcccgactggagaggctgggtgacaatgctcagtagccaaattattcttagctggaagtgggttgcttccggcttagaataagactcgtatttgagatgacgcgggttatgcgttagctcaaatcgacgtcggcttacgttccagcaattgtcacccagcccccggaggtcggaatcggacgcgcattgctgacgaacaggaatccacctaaccggcacctttcaatcataattaatgaaaagatactaaaacgggtgtgaaaaggactgacttttcacacccgtttataactgcttcattacttcaacatacctggcatccaatcaaattctaagcttggatcggcattcagcgtcgcgtcgccgaattggtgatgctgatattgaacatagcccgcagcaccaatcatggcaccattatcaccgcataactttagaggcgctaagattagttcggtgtcagggaaagcggctggtaaatcttgttgtaaccgttcacgtagcccctggttagctgcaacgccaccggctaagaccaattgcttaactggatattgtttaaggactcgtaacgttttactcatcaggacatcaaccacgctagcccgcaagctagccgctaaatcgtgttcttatccagagtcgcgccaatttgatctgcgtgatggaccgtattgatgaacgcactcttcagcccactaaaactaaaatcgtaattatcttcatcaatcattgctcgcggaaatttgaaagtgtcgtggctcgcatgtgccatctcgtcaatgactttacccgccggatatggaacacccaatacccgaccgattttatcataggcttcaccagccgcatcgtcacgtgtttcacctataatctcaaattgcccatctgcttgcatgtagaccaattcagtatgaccgccagaaactaatagtgccattagcggaaattcgaacggcttaacgaaccgagcagcataaatgtgcccagccatatggttaactggaatcagcggtaattggtgcgcgtatgccactgtcttagctgcattaacaccgactaacagtgcccccactagaccggggccatacgtcacggcaacagcatcaaggtcagcatacgtcacgtagtgtgcctcttgaagtgcggcttcaatacaaattgtaatttgttcaatatgatgacggctggcaacttcaggaaccacgccaccaaaccgtttgtgactattaatctgcgttgcaatcacgttggataaaatctcatggccatctttgatcactgccacactagtctcgtcacaactggactcaaacgctaaaatcaagttttgttttccacggttcccatccttttaattaatcattttacgcatgatccacgcatcttcttcgggatcatgataatattccttacgcgtggcaatctggtcaaagccgcattgctgatacaagcgctgggcggcgagattactagcccggacttctaggaatacggaccccgccgataattgtgctaagcgggctgttaataaccaccgcgcatgcccttgacgctgataggccggatcaattgcaatattcgtaatttcggtctcatcaagcactgttgagcggctgacaaacccgatctaagttcatcccgccaccgtaataaatcatagtgtaccgttggtaacgccatgtccgccgcaaacgtcgcttgccgccaaggtgcgccaccgggatatgctaatgtcgctaactggtaacaaacttggacggcccgacccgcgtcaagctgcgtactggcgacaagctgtcgttcagtcatccgtagctaccggaatacgataagtcatatcaatagcatcttcatggtcgccaaaatagtaccgtttcttgataccagtcttttcaaaccctaaatcgcggtaaagttgttgcgcaatcgtattactgtaacgaacctcaagggtcaccgtttggtaatgcaacttacgcgcccgcttcatcatgacttgcatcataaaatggcctagtccttggccttgaacatcaggatgtacagcaatattggtgatatgtgcatcttggcggcgatcatcaaagacacaaccacaaaaagcgacgaggcgatcttcatgacgcatcacaatatagaaacgaccgctctgtcggcgaagttccgtcttaaacgcattttcatcccacggtgtctgtcccgcatatacggcccgttcaatggctagcatctcgggcacatcggtaatcagtgcgcgtgagacatagtaattgacttcgcccactttaacgatgtgattttgaatggccaatacacgttggcggcgttgattgccaccggtggtcattttttgaaagtactccttaaattttctcaacatagggcgcatgttccttttctgggtgcttggcttgccaatcacgttcagcttgcgttaaacgcaaatagttcggcacaaagttatgaatttcactcacgggtgtcagcgttcgacccatcaaacctagtactacggcttggggcaagtcaagttgtggggctgcacgaacgaactgcttggctaacgattgctgcaaagcatccgcatattgatcgacatccgcgccgacaaaggtaattggttcatcataactagctaatcgttggccccactcggtcacactgatatgttgatcagcgataacggcaactggacgctggttcttaatccgatataacccggcaaagatgttgtcacgacgcgcatcaaataacggcgccactaattggccttccgtcacaatgttgccagctaacacggccaaactcgatacaccaactaaggctttatctaatgtaaaggcaagtgttttagcagtcgtcacgccaattcgcaaccccgtatacgaccctggtccggcagcaacgacgatccggtctaaatcagctggtgccaatttagcttgagccatggcttgttcaataatcggtaataatgtactactgtggttacggccaacattagtggtcgttgtggccaagatctgggtatcttctaataccgcgacactcaatggccgattcgaagtatcaatcgccaacaacttcataattttaaaaaactcctcattttgaattacttcacatatcttatcataatttacttactttgaaagctttacggtagtaaccaaccaattcaatccagaaacaatcaacaactatcctgaccagtttccactcatacttaccaatcactgaattgaaaaccgaatgtaaatattatttacataacttatacatatacttcactaatccttgtccgcacatttacaataccttgttatgctacacaagtaactaaaattacttggaggtaattggaaactatgtcaaaagttagtaagtcattattaggtctttcattcatttcggttttaggtttaggactcgcaggttgcgctagcggaaccagtgctaaatctggtggtagcagtacggatagcagcaaaaccatcacggtggtcttctatcctaacgaatcagccaagagttttgctggttcccgtacggccattaagcaagcagttgaaaaggcaacgggtaagacggttaaattacaaaccacgaccgactataacgttgcgatccaagcaattgcatccggcaaagctcaagtcgcatacatgggggctaacggttatatccaagcacaccacaagagcaaagatgttgtaccttttgccgcacaatctgatgctaaaggtaccttgaaagacgctacttataactcctacttaatggtacaacaaaaagatgccaaaaagtatgaagaaaacggtaagtacagtattaagaacgtcaaaggcaagaagatgtcttatgtttccaacagttcaacttcaggcttcttagtaccaacggctgaaatctcacgtgaattcaacatcaaaaccgctgaccaagataaattaactcaaagcggatcattctttagtaaagtgctctatggtggctctcatcagggttccgcggtcaacttaatcaagggggatgcggatgtcgctgcctttgatgatgctgatttaatgccatacttaaacgttaccaagggatcatgggacaaggtcggctcaacttttcactgttaaggataacgccgaagcgccatttacaagtttagccggcaagtcggtcgttaacattgccatgatgcctgttcaacaaggcccatgggtatacaataccaaggccctcagcaaggatgatcaaaagaagatcgccactgagttcacgtcgaagtcctttgcccaaaacaaaaagatcttctctgaaccaaatgcgaagacaccaatgatgttccctaagaaatcagaaaagtccaaattagttaatgttaccgacaagtggtacgcgccaatgcataagttagtaggttactaaaccacgtaccattagttcacaaggaaaggatttgccaatgctcaaggttattcagctagataaaacatatggttccaataagcattcgctcaaagcagtcaacttcacagctaaaccgggcgaagtaactgccatcatcggcccgtctggtgctggtaaaacaactattttacggagtatcaatcagttgatccgcgattgatagtggtcaaattttgctcgatgacactgacattcgtcaagcgaacaaagctgaattacgcaaagttcgtcatcatatcggcatgattttccaaaactacaatctgatcagtccgttaacggcccttgaaaatgttctgcatggccgcttaggcgctaaatcaacggttgctggcatgctcggcctttacagtagcgccgaaaaacaagaggcgctacaactactcgacgaagtagggttaaaagaatacgcctaccaacgttgcgatcaattaagtggtggccaacaacaacgggtcgggatcgcacgggcattaatgcaacatcctaagatgattttatgtgatgaaccgattgcttccctagatcccaaatcaacgaccattgtcatggacattctacggcgattggcaaaggaaaaacaactgattatcctcattaatctacatcaggtcgatatcgcaatggcgtacaccgaccatatcgtcggcattaactaagcggggccatcgttttcgaaggcgccactaatgaagttgacgacgcggtcttacagcacatttatcgccaacctgaccaatcaacggcggtggctgccaatgaaaactaatccaatgacaccgcaacgctttttttcggcaacgtcggttgcgattatcagttgttttgctcattttaattggcatctacgtcttatccatggccctcgttaattttcaggcgtgggcttcgatcagtaagattccagcgggcttaatgtggttgtttaccaactttattccgacaagtcgttcgatttcttatctgggaccgattctttatcagctgtggcggaccttgctcgtggcaatttcatcaaccatggtcgctagtctcttcgccctgatctttgcgattctcggtgctaagacaaccaccccaacgcctgtcctccgctggattattcgttttggtgcttcactcttacgtaatattccggtggtcgcttgggcgatgattacttctgttttcttttaaacagagtgactttacgggcttcttggcactgttctttatgacgctaggctatctgacacgggcctttactgaaactattgaggacctcgatgccgaaaagcttcaagcactgcaagccgttggcgccaactatttccaatgtgtcttctgtggggtgttacccgaagccgctagtaccttgactagttggattctctacatgattgaaaacaacttacgggacgcaaccttggtcggactcttgacgggtacgggtgttggttttctctttgactactattttaaggcgttccgctatgacgctgctggtctaattgttttgttaattgcgattttagtcattgttttagaattgacatctaatcgaattcggagggcaattgcatgattgaaaacagtcaacccaaaacacaagtacttcaaccgtcagcaccaccaacccggtcgatttcgttggtgactcggccccgcaaaatcctcgcgagccgttatgattggcctaacgcttatcagtgtctattcattagtcacactcaataatgccaacctgaacatcattgacgctttgcatagcttaggtctcaacctgaatgctatgttcttacaccctagcgttggtcaagacacactggggcaactcttacgggccctaatgactagtgtttcattagcgatgttgacgactttgttaggagcgctaatcgccttcttcattgccgtcggtgctgcccgtaacttagcacccagttggttagctactagtattaaagcagtcatggcctttattcgtgccattccaacgattttatgggtgttaatttactccgtagtcatgggattaggtgctagtgccgccgtggtcggcttgaccttccacagtgtagcgtacttggttaaggcttattctgaaagtattgaagaaacctcgcaagatacgattgaagcgttaaaggcgagtggcgtgggtttttggccaattgtttttttcaggccattctccgtcaatcattccagcacttcttagctggacgtttatccggtttgaaattaactttgccaatgcggtcgccgttggtgctgcagctggtgctgacgatatcggttactacctcttcatggctggcagtttctacttcgatttccatgaagttggtttgattgtctacctactcttgggtgtcgcaatcgtgctcgaactggtttctatgcggttacgtggccactacttaaagaacaactaagtaaattcaaaggagttttcatcaatgacaattaaagcagtaatttttgactgggccggcacgaccattgactatggcagccgggcgcccatcgtggctttccaaaagcctttgccaacgttggtattcaaatctctgaagctgagattcgccaagatatgggactagataagtacacccatatccataaaatcatggatttaccggccgttcaaaacgactggcgggcgcgtttccaagtcttaccgactgaagacgactgcaatcaaatctttagcaacttcaaggcaatcttgcttagctccctgactgaattcggacaattaaagcccggcatgtcagctgtaattgactatttgaccgctcacaatatcagctatggcacgaccaccggctatgacgctgaaatgttagctctggtcttaccgattgcagctaagcaaggctatcgtcccgccgtcaacatcacttcagaacaaactggtggtgttggtcgaccagcgccggcaatgcttgcgttagcagctgaacagctcacaatcaccgatccaacgaccgtcatgaaaattggggattccgttaatgatatcttagaaggcaacaacgccgacgcagtctctgtagggattattgatggtagcaacatcatgggactttctgagttagccttcaacgcccttagccccgccgaacaagctgaacgacgagcccacgtcactgccgcttatcaacgcgctggtgcgccgattacattttacaatcgatggctgaattaccggcattgcttgatcaaatcaatcaaccggttgccactgatcattagcagacaaggagcccgatttttatgaaacaaccttatttactcctaacacccggtccactcagtacgactgccagtgttaaggacgcaatgcaaattgattattgtacttgggatagtgactatcggcacgtcaccgaaaccattcggcaacaaatcttagctatggcccaagccaatccagaaaactatacgaccgtcctactacaaggaagcggcagttttggtgttgaggccaccattggcacagcagtaccacggaccgatgcaactttaatgattgccattaacggcgcatatgggcatcggatcagtcaaattgcagaatattacgatattccacatatcgacgttgtgttcaacgaagatgaagccgtcgatccggttcggattgaagcaaccttagctgatcatccggagatttacccacttcgcaaccgttcatagcgaaacgacaactgggattctcaacccaatcgaagccttaatgcctatcatgcatgaacacgggatcgtaacgatcatcgatgccatgtccagtttaggtggcgtcccgattagcattgatgaattggattgtgactacttgattagtagtgccaacaagtgtgtgcaaggcgtgcccggttttgcgttcatcattgcaaaacaagcgaccttggcccacactgctgacaacgctcgttcactttgtctagatctctacgaccaatggcaagccatgaccaagcaaccaggaaaatggcgcttcacttcgccaacccacgtggtacatgcctttgcgcaagcactcattgaattgcaagcagaaggcggcgtgacaccacgctaccaacgttaccatgctagtcaacaactccttagcgacggcttacaagcgctaggttttgaattagtgattgatccagccattcaagggcctcatcattacgtcattcaaatacccgaacgtcgactttgattttgctgacttctatcagttcatcaagcaacgcggcttcgtcatttatcctgggaaggtttcaaatatccctagcttcagaattggtaccatcggtgatgttgatacaactgatattcaacgactcttaacaattatcggtgattatcaacaacttcaccgctaactgcattgatcaatctaaaaggtgcgtgccaaggattcaatcctgacatgcactttttttgacgaccacaaaagcggctttgaaatctattgacgagatttcaaagccgctttcaattatcagctaaccgatactagtcacgatcatcgtagccattgggatgcttctgcgtccaagcccacgctgtttcaataatatcgttaacattgtcataatttggttgccatcctagcacgtcacgcgccttatcactcgccgcaaccaatgagtctggatcaccaggccgccgtggtgctagcttagctggaattggttgcccggtaacttcacgagcagccgctaacatttgtttgttagagaaaccagttgaagaacccaggttaaaggcattgctgtcatttccgcagccaagtacttcaaagccaagatatgtgcatcagctaagtcgacaacatgcacatagtcacgcacattcgtcccatccggcgtattatagtcatcgccgaagattttaagttcatcgcgttttccttgcgcaacttgtaaaatgattggaaccagatgtgtttcggggccatgatcttcgccaatactgccatctggcttggcacccgcaacgttaaagtaacgtaacgcgacaaacttaatgccataggcgacgtccgcccagtgcataatctgttccatcattaacttgctggcgccatacgggttgattggtaactgtggatcagtttctttaattggaatctgcttaggtgtcccataagtagcggccgttgatgtgagagagaagacgatttgcttcacattatgggctgcatcgtttcaagtaacgtgatcatcccaccagtattgttatcaaagtacttcagtggcttactcattgattctggtacgattgaaaaggcagcaaaatgcacgacagcttcaatatcctcagtatcaaaaacgtgattcaaaaaatccgcatcccgcaaatcaccctgataaaacttggccgccgaattaacagcagcacggtgtcccgtgaccaaattatcaacgaccacgacgtccgtaccgtgttctactaaccgatcaaccatgtgagaaccaatgtagccagctcccctaaaactaaaattgacataatgaacctcccctgtatggatgtattaatcatagcatactgaatcgctagcgactctaataaaaacgtgcgttctaatcgaccaagtcgctcacgatcacatcattaacacactagtgtaaataccaacccagcaaattactgaatcggctctggtaaaagtccgccattgaatcgtaacctcacaacacttctcatcatcaacttcgatcaaatgactcgtcgtgacctgatcggccacttcgctcggtaagatgttcgcatgagcagtcaccgtttgcccgtacttgacttcattttcatagcgaacgtcaacgtgaactaaatcatgttgaagcaagaacgtcgcgggtagcgtatctacgagccaatcaaaatagtgtgcattattaacatgccggttgggatcaatgtcaaagaagcggacatggtacggcttcgtaatcgttgtatcggtcgcttcaaaactaatcggtcgtggcaagcgcggaatgcgcttgacgacttccgactgatacggcgcgaccagttctggtaaaatttttacgattcgccgggtcgtttgactcatcatgacccagatactcgtaatataggccaactgttgaccatctgcgtcccgaatccaaaattcacggtaagcaaaatatggattataaagcactaccccgaacggcaatcgtaacgacttcgtcttggcggggcatccgtgtaatatcgatggcatattgcgtgacgacccaaccgacaccatggctttgcaccatttccgtcgttaaaccaagggcgtcgctttgatcctctgatgccagtacggcaatatcaattaatgtcgttaaggttgcgcgaccagtgcggtcacattcataatacgtaatccggtgctgttcactgtaaagactcgcatttgcgcctaaagttgccattcatcaagactcctcatcgttggtatttagttcatgaaattgattataaacgctttgccggggaatatttcgtcgcttcgcaatcgtcttaatggccacgttgggcttatctccggctgcaatcaacgcttcgacttgggctttgactggcaactgtgccaattcatccgttgtttctggttcatccttatccggattaccaccgatcaaaaggacaaattcgccctttaactgactgatgatcctgcgcccacgtcaccatttcagccaaggttccacgcgcgaattcctcgtaacgcttagtcaattcccggcacgccacaattggccgcgtcccttcacagacggtcgctaggagggtcaaggtcttggcaacacggaatggcgattcgtacaagaccactgtttcatgtcgccgagccaatttagccaaatcagctttttgttcattcttcttacgcggtaaaaagccgtagaaataaaatggctgtggcactaggccagaagcaatcagcgcagtcaggccggcattggcacctggtagtggcacgactggaatattcgcggcaatgcaaggctgccacaagttctttgccgggatcactgattgacggcatccccgcatcgctaacttgtgctaagttaacgcccgtctgtaatttttcaattaactggggaatccgttcttgggtgttatgttcatgaaagctaatttgtttcgttgtaatttcaaaaatatgattcaataacctttgggtattccgggtatcttctgcggcaattaggtcaaccgttttaagcgtcgccactgcccgataagtcatatcctgtaagttgccaattggcgtcggtactaagtacaaggtcccgatacccgcatgatctgcaaaactttgttgtgtttccaaaacgtcctcctaacaatcctctcgaccgtgacttgttcctatgagtgactcgtggtgaaaagcacaaaaagtctgggactactcccagactttttcgactatgcacgttcacgttcaccataaatgacttccaaacaaaaacgcaggattcgtcatcgtcacgccgtttgccgtaaaactggttgcagacgtggaagccctcatcatagagtttttccaagttttgccgtgactttgagagcgtggtcgtgctagccgctttttcggcaattcattttcaatttcgaccatgtgttcacgtaaatgttcattttcaatgaccaattccgcgcgtttttctctaacaccgttgtcatatcggcgcgtaacttagccattttgtctagcatttgttgcatctgttgttccatctcaccgaaactatcgtataaatcacgcttatccacgcgctcaccctcgttttcctttatttaagcgtttgtttgaaaaatcggccataactttaacgttaagccttctaagacattttgaaaactaatattgctagctagctggcgcttggccgttaaagctagttctgtcgccgcaatcaactgctcatcgctgacttcagccgttaacccggccaattctttttggtactgaccaaaggttaacgctgtcgttgccacctcaaaatgtaattgcaatagatcttggaacaaggccgcaattaaatccaacataaccagctgatgatcagcgtccttagccaaaccaactaaattgacccgcacagccacaaaactccgtggatcacccttaacagcctggtcaaaccaccgccacaaagtgcttgcgcagcttgtggtaaccaatcatccgctagcaacgctttttgcgcctgggtcacgctatttgtcaggccccgtaacatctgcgcttggtttggcgcaatcccggcctgttcaaacgtctgctgtaacgcctgcgcatttaatggtgggaattcgatcacctgggttcgtgaaataatcgttggtagcatcagttgcttattagtcgttaataacaaggccgtgacgttaccacttggctcctcaataaacttcaataagctattggcagcactcgctgtcatcttctccgcatcattaatgatgaacagtttccggttaccttcgaccgcactcttagagaattcagcttttaagtaacgaacctgatcaacgtgaattcgctgaccctcgggagccactgtcacaatatcagggtgcgacccattagcaatccggacgcactcctcacaagtgccatctggttcaccatcattaatatgcgaggcagaacaaccgtttgcgcaatccaatgggccagttctggttgtccagcgccttccatccccgcgaataagtacgcgtgggccagatggttctgggcgatgatgtgtttaaatgccgctaataagcggggctgtttcgccgctaacgtttgcgcaaatgactcggttgttgccattaataatcatccttcattaaaattggtgaaattgttcaattggtagaacaaagaccgtggcgccaccgacttgaacttcaactggataggcagctgcgccatccatcgtcacgtctagattgactggtggtgtcataaactgttcccgcgcatgactcgtttctttaatcatggctaaaacttcatccacacggtcatcatcaataccgatcataaaagtggtattacctgaacgtaggaagcccccgtcgttgagagcttcgtggcccgaacattggcttcaatgaactggctgctcaaccggttactgtccttatcttgaacgattgcaataatgtaatttcattggtcttcccctcccttggatgccacataagccggtaactgtgacgccataatctctaaggcccgcgtcacaacttggtccaatggctgacttgcatcgacgcgcttgatacggtcaggatgatcagccagtaatctcaaatacgctgcttgcacccggtgatggaaacttaaggcttccacgtccaagcgattaatttcattttggcgatgttgttgaatgcggtttaatccaacggcagcatctacgtcaaaatacaacgttaaatctgcggttagccccgcggtcgcgaactgattcatatcataaaccgcttgttccccaataccacgaccagcccctgataagcgaccgagctatcgatgtagcgatcacacaagacaagttggtcgttctgcaatgctggttgaatggtttggacgatatgttgtcgccgtgctgccgcatagagtaacgcttccgtacggtcgtccatcgccgtattatgacgacggtctaaaatgatttttcgaattgcttctgagatttgattcccgcccggttcacgcgtcacaactaagcgatcccctaattgtggctgtaatttggccacaatcgcgtttaaagctgacgttttgccggcaccgtctggcccttcaaaagtaactaattttcctgtcaacattcccaatcccatctattttcttatatgtagcaattgtacttgattttggaaggcctgtctaatccggttgccactagtgagggtatttttgaccgattttagggacgatagctactaccaattgtggttttgataatttattcggtgaattgctaaaaagttattaggtagtactacccacgattgataaataccgattttagtttgttattcattagtagattccaattgccgcacctagcatgtcttaatcacaatgcatgacagattaactggtaaaataatgctagggttctaaatcaaaagacgcacgccatagatttacaaaaaaaaatcaacgacgtgcgtctttattttgaaacaagttatctcttaaatcactaacagtctatttatcaatgaccgagcgctgaatcgtctgcccatgaacttgacgtaaacgtgcttcacgatacagatataaatacttagcacgcgctaaggcggtctgcgtaactagttcactcgtattattatcatagaccgcttcttggttctgcttcgcacggtcccagtccaacttagcggcattcagggtcgacaacaactgttcatcaaaaacttccttgggatgcttgatcttctgtttacgtttaaacatggtggcacctccaattacatttcttggcgaccttcaacggctttgaataaggtcatttcatccgcatattgaatatcactaccaaccgacaagccgtgcgccaatcgggtcactttgatccccgccggcttaactaaccgcgagatgtacatcgctgttgcttcaccttcaggcgtggcattggtggcaaataatgacttccttgatggcttcattttgctgtagccgtttcaataaactggcaatgttgatatcttccggacctttgccatcaatgggtgacaataccccatgtaagacgtgatacagcccgttgtattccttaatcttttccattgccatgacatccttggcctcttcaacaaccagaacggtgctttgatcacgcgacttatccttacaaatcacacacggatcatcttcggtgatattaccgcaaatactacaaaaatgcgggtcccgtttggccgcaatcagcgacttagcgaactcggtgacgtcatcaccgttcatatcaattgtataaaacgccagccgcgtcgcagtcttgccaccaatgccgggcaacttcatataactatcaatcaacttagcaattggttctggatactgcatgtacttacctcgtttttactgtaatcccttagtatattttcccatcgtactttgtgtctgttcatcgaccttagtcaacgcgtcgttcaccgcagcaacgactaagtcctgtaacatatccacatcatcaggatcaacagcatcagggttaatcgtaatatccttcatcttcttatcaccagtaaaagtgactttgaccatatcgtctggcgccgcacccgtgaaggtttgttcatttaaagccgcttgttcggctgtcattttgccctttgcatcttcttcatttgtttcatcatactttgcatattgcccattccacgcatcataattatcagttcctttcgtctttagtccggctgtacttcaactaaatcaccgaacatgttcttagcttcttcaacgaccggttctttggccggtgcttgttgctctgatgttgcacctcctggctggtgagtggccaaataatccttacgaatttgtggccactgttctttaggcacacagacaatcttgggtgcctgtcccatcagccgatccaaaccatttccgagtgcatcgatcaaggtctgtggtcatcaatcgctttttggtaaacaaacgcatagtcaaacgcaaccacaacaccttctgaactggccgcaactggttgggccacgtgcattagggcccgctgcgtcacactcaaaatattcatcaaatcagtccaaacatcgcgcaccttaatgagatcattcttcgttgccgctcccagaataggataaatctgactgacattaaccttcttaacaaccgggccattactcgaccgcggcttagccggtgcgggtttagtgatactaccaccttgagaacgtaacgttttgacctcgctttgcaactgttcaacttgttgtgccagtttatgcacagtgggatcttcaggattgaccgttgccgcagctaccggttgaacggccgcttgaccatccaactgagctagcttgaccgtcaacacttctaaataaacgtcggggtgcgtcgtgaaccgcatttgttgttgaatatcgttcaacgtcttgaccatttggtacaggacttcagcatcgatttgcttggcaaatgcttcaaattgttgatcatcctcgcccatcgccacactatcgaccatttcaggggcctgttgatagagtaacacgtcacgcgtataactgatcaaatcttcaatgaaacggttcgcatctttaccttcttgtaagatttgtcgcatcgtctctagtgccggcttcgtatcatggtcggtgacctcactgacatagttagccagcaactgcttggtcacacttcccgtcaccattaacgcatcatccaacgtaaccgtgttatccccaaacgaaattacttgatccagaatacttaaagcatcccgcattccaccttcagcagccgctgcaatgacgcgtagcgctttttcatcataggtcacatccttctcattgaggatgtacaccatccgatcgtagctatccttagctgtaatccgccgaaaatcaaaccgttgcgtccgtgaaataatcgttaatggaatctttatggggctccgttgtcgctaagataaatataacgttagccggggttcttctagcgttttgagcaacgcattaaacgcgccagtcgataacatatgaacttcatcaataatgtagactttatagtccgcttgcgttggagcatacttcgctttgtcccgaatatcacgaatctcttccacgccattattagaagccgcatcaatttcgatgacatcatttagttgccccttggtaatcgccgtacaagtctcacattcattgcaaggttccccatcaacaagatggtgacagttaattgccttggcaaaaatctttgctgccgacgttttcccagttccccggggaccggtaaacagatacgcatgactcgtctggtgggtcataatggcatttttagtgtctgggtaatcatctgttgcccgacaatctcatcaaagcgttggggacgccaaacccgatatagtgcccgatacatgcgattcttcctttcttacatcagtcatactttggttatcattacttattataagccattgtttaaacgtcctgaacagttagcttcctggttgtgctgcttccactaacgatcagtgtcggttatgcaaattaagcatctaagcgcacttgccaacgagtcgatgcccaggcctttaaccacctttgttaggcgtttggttattccttcaacaagcagtggctttaactatcagcctgaaaagcatcacccaaataacgtattactactataatgataggtaaataaaaataaaccaacctatcagcacgttcaaaactagcactcaatatttaatttaaataaaaagctctcaaccgaatggctaagagctgttacatttcataaaaacaaaaggcacaagatgaagcaaacttagtgctgcttccttccggacctgacacgattcgtaaatccacccttgccttttggccttgcggcaaatactataatacatgatttgcgccacaattaccagccagtcggcctaatttttttcagcagcttcacgtcgtgctttttagccgcctttttccgtttacgaatcccacggaagaagttttccaacatctcgccggccggacgtgccaagatgcgttcatgaaccgttacttgatgatttaaccgggtatcatccatcacctgatacaaactacgaacggcgccagccttgggatcacgggcaccaaagtagagttcaggtagccgtgcattaataatagccccactacacatcaaacatggttccaaggtgacatatagctgacaatcggctaatcgccaactatgcaaatattcgcaagcttcctgaatcgcaataatttccgcgtgcatcgttgcatcctgaccatgctcccgtaaattgtgaccacggccaataatttcaccctggtgaacgatcacggccccaatcggcacttcgccaattaagtaggccatccgcgcttcatgtaatgcttcttgcatccagtcttccgctgttggggttccgtcacgactatccctcctttacactttgtaggatgtaataccctttgtccttcttaatcacctgacaattaccaaaggtcgtttgcatcaatttcttcgcagatggtgcgccccgctttttctgtaaaacgacggtgagtgttccaccaacgactagccgtgaaacggcccccgttaacatcgcatccaccactgccttaccgcgcgcaccggtgggttggtgacaatcgccgcgtaattagtcgcggtcacttgttgatagacatcagacgtaaaaatattggtattcgtaatttggttcaaagcaacatttttacgcgctaagcttagcgctaactcgttcacatcgaccatatcaaccgttcgttcgggtgattgatacgcgagcgccatcccaatgggaccatatccggttcccaaatctagcattgggcccgctggcaaatcagttggatcaaacgctgcaagtagtgttcgtgagccgtaatccgacgacggtacgcttggagaagacaccgttgtccgtcgtaaatttaaacgagtgattaaaaatttcaaaattccattgcttttcatcatgcacaatatccggattgtgtgtataataatagttggtcatatttattttcctctaaatttctggtctatatctatgataactgattcagcgagtgaaccacaaataatttaaaaaactttttagtcggttaaaagctgacactaacacaacatctagggcttgtgatttttaccacaccctagatgttgtgctttttgattgtttttttcaccacatgttgtatactaaatttatcagaaaaacgagttaggatgatgaaaaatgaaaaaagttactgtatttactaaaaacaactgcatgcaatgcaagatgactaagaagttcctcacggcgcacaatattgcctttgaagagaagaacatcaatacgaatcctgaatacgtcgattacctgaagaatcaaggtttccatgctgttccggtcgttgaaatcaatggcgaagacagcattgccggcttccgtcctgatgctttaaaacaattagctgtttagtttgttcacgcttttttgcgtggttacatagctggtttaccctttaaaatatgataaacgacccacaatcatcaacctactgattgtgggtcgtcgattttgccagccacaattatactgatagaaagaggattccttatgaccttaaaagatttaaaagacgtcacgtattacgacttaaataatgagatcaatattcccgttaacaatcagattccgctcaacaaggatcaggaggcacttgccgctttccttgaacaaaatgttaaaccgaacacgatgaaatttgatagtcttaaggcgcgctttgactacctacgtgaacacgactatttggaaaccccgccattgataagtatgattttagctttatcgaaaaactttacgattacttgcggtcgcaagacttccacttcaagacgtttatggcggcttacaaattttatgcccaatacgccttaaagacggatgatggcgactattacttggaaaactttattgaccgtgtggcaatgaacgccctctactttgctgatggtaatgaagacttggcgatggacctggccgacgaaatcgttcaccaacgttatcaaccagccacccccagttttctcaatgctggccgggcccggcgtggtgaattgatttcttgcttcttgattcaatcgaccgatgatatgaactcaatcggccggacgattaactccgcgttacaactttctcggatcggtggcggggtcggtattaacctcagcaacttacggggtgccggtgatccaatcaagcatatcgatggcgctgctagtggggtcgtacccgtcatgaaattattagaagacagtttctcctactctaaccaattaggtcaacgtcaaggtgccggggtcgtttaccttagtgtctttcatccagatattatgtgtgcctttctttctgctaagaaggaaaacgccgacgaaaagattcggctcaagacgctttcactcggtgtcaccgtacccgacaagttttacgagttgatcaaggctgacgctgatatgtatctcttcagtccttacggcgttgaacgcgaatacggggtaccgttctcatatgtcgatatcaccaaagaatacgacaatatggttaagaacccgaacatccgtaaaactaagatcaaggcgcgtgaccttgaaaatgaaatcagcaagttacaacaagaatctggctacccatacgtcgtcaacattgataccgcgaaccgcgaaaatcctatcgacggtaaaattgtgatgagtaacttgtgctcagaagtgatgcaagtgcaaaccccatcattaattgatgaccaacaacagtatgagaagttaggaactgatattagttgtaaccttggttcgactaacattgttaacttaatgacctctccagactttggacattctgttgaagccatggtgcgcgcgttaacttttgttactgaccactctaacgtcgacgtcgttccttccatccaaaaagggaaccgtcaagcccataccattgggttaggtgccatggggctccatgcctttttcgcgaagaatcagatggaatacggcagtaaagaagccgttgactttaccaatatctacttcttactcttaaactactggaccttaaaagcttctaacgaaattgcgcgtgaacgtcacgaaaccttcgttaactttgaaaaatccaagtatgccgatggttcttactttgacaagtacaccacccaagattggcaaccaaaatatgacaagaccactgcactgtttgacggtatcttcattccaaccaaagctgattgggaagccctcaaagaagccgttatgcgtgatggcctctatcatcaaaaccggatggctgtcgccccaaatgggtcaatctcgtacatcaacgatacgactgccagcctcacacccaatcatcaaccgggtcgaagaacgacaagaaaagaaaattggtaagatttattatcccgctccttacctatctaatgatacaattaactattataagtcagcatacgatactgatatgcgtaaagttatcgatgtctatgcggctgctcaacaacacgttgaccaaggaatgagcttgaccctcttcatgcggtcaactattccagctggcttatacgaatggaaagatggtcgcactgataagatgaccacgcgggacttaaacattttacggaactacgcctaccgcaaagggatcaaatcgatttattatattcggacctttacggatgacgatggcgaagtcggtgttaacgaatgtgaaagctgcgtaatttagtatcttagatctctaggaggataacaaatggcaacagacttggcttactaccaaaaactgctcagtaatggcaactataaggcaattaactgggatcgagtttcagatgcaattgataaaagtacttgggaaaagttaaccgaacaattttggttagacacccggattccagtttccaacgacatggcagactggcgtgaattagatgatgatcaccggtgggtcgtgggacacgttttcggcggtttgacgctgctagatacgttacaatcacaagacggtctgcaagcacttcgccgcaacgtcttaacttcacatgaaacggccgtattgaataacatccagttcatggaatccgttcatgcaaagagttattcaacaatttttgaaacattgaatacgccggacgaaattaatgaaatttttgactggagtgacagtgaagaattcttgcaagcaaaagcccaatggatctacaagctttacgataacatcgacgaagatccattgaagcaaaaagttgcgaacgtctttttggaaactttcctgttctattctggtttctatacgccactgtactacttgggccacaaccaattgccaaacgttgcccggaaatcattaaattgattttgcgggacgaaagtgtccatggcacttacattggttataagttccaattaggcttcaaagaccgttctgaaaagcagcaggcagaatttaaagactggatgttcgatttcttatacaaactctatgagaatgaagaaaactacattcatttagtttacgatcaaattggttggtctgatgaagtcttaacttttagtcgttataacgccaacaaagccttgatgaatctcggccaagatgccctcttcccagatactgcggaagacgttaacccggtcgtcatgaacgggatttcaacggggacttctaaccatgacttcttctcacaagttgggaatggttaccgcttgggtcaagttgaagcaatgcaagacaccgactacgatattggtaatccagacgattaatcaacacgttagttcacaaaaatgcggcgcctatccgggccgcatttttgctagaaaattttatcttgggggtaagtttagaatggcaattcataatatctgtgtttttgtgggtctaattctggtttagatcccgcatttagtgagaaaacggtggcactcggtcaatacttggccgctaatgattaccaactcgtctatggcggtggcgaccatggtttaatggggaaagtcgccaaagcaactatggatgctggtggccgcgttatcgggatcatcccgcattttctggtcgcaagagaacttgcatttaaggacgtcacgacttttatcgaaacgcgcacgatgaccgaacgcaaggaaaagatgcttcacctcgctgacgcctttatcgttttacctggcgggtttggcacctttgaagaattcttacaaatgttatcttggagtcaaatggatattcaccaaaagccgattgcgctctacaacatcgacggcttctacgacgatctagtcgccatgctacaaaagaccgccgacttagggtttgccccgaggctaacctcgacctaattcattaatgggcatgatcttgatgaaattttcgctggtttccatgatttcaaacatgtgttaccgcctaagtatacgaactaaataatttagcctacgcaaaacagctctagtgcttctgccacaattagttcagccctcatcatattagtcggctgaattctaaagtcatcataaaatgccccatcattgcttctcgcagtgatggggcattttgctatgtcattaacgatacttactttatgacatactattcagttatttcaatcgtttcaacaaccatactggccggtgccgctcagacttgtgtacccgggtattaacgacttgtagcaattgtaaaatggtgaagattagtgaattacgttttcggtacgcaatgtacttcggttcccactcagtcacatacttctctttgtacgaccgtaatccctgaaaaccatataactggtagccatattcgtaaattaaatgagcaattttttcttgaataaaactgtagtagcgtgaaacccctacaccggataatggtgccattcccatattgaaataagcatagccatcgtcacgcgcctgttcaaataggtgcacaaagaccgtgtccataatgccggatggcgccgatttgcttgaccgcattaagtcaattgaagtcgtctgatgatttcccccgcggcataatattcgcaaacgcgacaattcggtggtcaggatcataaacgaccgctacgggtgcctgattgagatactgctcatcaaaaatccgagcgagaatcctttttccgtctcacccgctaaccaactatccgaaacagctcgtaattcagccataacgtcggcactgaacggtggctgcaagatggcaaactcatagtgatcccgggtaaacttattcattagggcccgctcaccccgtagccgtttaccagccaaactaaagtctgccaatttaacgtgcccttcttcaccggttttgataaagtcaaagcccatttcgtgctaggcgcatcgtcagcatctcactaatttcgtaaaagactagcgagcaaccgtcactatctgcgtcatccaataactgttccaaggcagcttgtaataccgtttgattaccgaatggctctcccataatgatcagtttatcagccttctgctggtataagaagatcagttgatcgaccccatcgacttgatagtaatatgctaacttatcattcaaataagccaagtgtgagatttcattgccgccataagtttcaatcacttgtttgacccgagccgcatccatcttttgacgcaatcgggcgttatagccactcgcaaagtagcggtacataataatcaaaatcattgccgctaagactaacccaatcaccccaaataaccagagcttttgtgatgggaagaacagagcttcaggaaccgcatgccgatgatgaatttggggcgcgttatagacccccacaatcgtatacaagataaaggtcaccacatacacgcagctaacccacaacgtttgcccccacgaaaaagccaaccgatcacgataataagcatgccgcgacaaagccactagcgctagaatcacaatcaagaaaatcacaaatttcatcgaaattgcatcataaacgacgagccagcgaatcgtattcaaaattgcaatcagcgggacaatcaccgttggccaaaaagctttttgacccggccagcagttcccaacgccaccccaatcagtaagaaggccataataatactgctggcctgattaataaagaaaaaggtgtacggataaaactgtaagaagagtttattgttatatgcaaagttagggaccgttgacatcaacaacatcaaaaaaccagaaaagtagagaaaaaccgtcagtaccatctgagcaacacgttgtaatgcccgcttaggaatacccgctaagcgcacgtttaagcgatggccggtgtcatggatgaataagaccaacccgatggcaaacgggataatatagtagtagaataaccggtaaaataagagccatgcgactgcgtctggtcgagaaactccgaccgcaccgaggccaaaaatcatgaaaacgtcgaatgacccaataccaccgggtaccattgacacttcaccgacaaccgaagcaatcacgaataacggcacgaccgctgcaaaatcaatgggtaatcccataaagtttccaattaataagaagaacagcacacagccagtccattcaccaaacgacccactcaataaccgaacgacgttgccgagcgtaaggccatcgaagaattccgaatcgttgactcgtgtaaaaataaagatggctggaaaatacagtgcaccaccgacgagccagatccagtaactgccatacatgttcccaatgccaaagccatagactagcacgagtgaaatcatacaatataatgacaatcccgaaactaaaaacaaagcgatcttggaaatggcaaacacgatttgtttcttagtggcttcgcgattataaaagttagcacgcagtgaggcgcccagcacgcccccaaaaccaccgatattcgtaaatgtattggtgatccatccagcttttaagatatagccaagtgaatagtggttgggtaaaaactttgtaatcatgacgtcatacgtcagcattggtgtcactgcgataataccaatcacgaccatgcttaacagatgccaccagctttgcgaagcaagcgcattcgccaactgcgcgccactgacttccttcgcaattttgccgacttccgtaatcacaaataacaggacagagaatacaaataatgctttgatgatccccatgcgtttattgagtgccgtcccgattttctgtaacgttgccttcaaaaaaattcccccattggtgtgtttgttctattatcgcaatcttagcctgtttatacaaccgttataggtcgttaataacccccacaggtctgatttgtcgccgtattaagctatgaacattttaaatacactgttactaaattgttccgaatgggtgttagtagttagcactaattatgattaattatcgaaattaataccagcataaaccaatattaattgatttttagttaccaaacttgctttaccaacctttaccgtttatgtataattaaagtgatacataagcaaggaggaatttcttatgcaccatgcaaaaaaactcgtcgttgcactaacgagtctactcatcttaaccggctgtaccactggtaatcaacaagccgccaaccataccagtgtcaaaaccaagacggttcgggttgagaaacggactgctgctaataaagccgcctgggcaaaagcaagggccgctagtcgggctaacgcggcctcagccaaagctcttagttcaaacacgacccaactcgcaattgcaactagtcaggctaagcgtcaatccgaacaactaaaagcaaaacatgacgacgcaatggcctcatcaaaatcagcgtcacaggctgcctggccaaatcagctgctagtgaagcggccgcacaatcacgctcccagtcagaagcccagtccgcttcggccgtcgcagccgctagccaatctaagcaagcggccaaggccagcagtcaagcagctgctcaaagtcaacaaactcaaactagtaccgcaaccacgagtcggcagaataatttttctggcgataccgataccgcccaaaccggacgtatcgtgggtaaccgcaattccaaaatttatcacgttgaaacagggcaaaactaccggatggccggtaaaaatgccgtttactttagtacggaagacgcagcgcgggccgctggtttccgtaagtcatttcgataggaggatcacttcatggcattgatcggcaccatcttattatttgcaaccctgtactggttctggcgcttacatcggcgctaccgtgggcgtcaatggtggcggcatagttggccggccattatcgcattgctcgtcagctttagtattctcggcacatctgatgaatccactcagccaactgtgaagacaaagaccgttactaagacacacttagtaacggctaataatgacaagcaattgacggcacttcaggctgccaatcgtgcttctgctagcagcttaaagcaggctgtgaaaaaactttcgagtagtcaacaacatattgacaaactcaaggctacgaacaagcaagctggtgcaacttcgacaacagcaccaaccaaggtcaattctgaccataacccaagtaacactacgttggcgagtaaaacttacaacggtcaacaaacgatcacgattaatcagaatcagcccgcatttaccgctaaggagctcagtacgagtcagggtgcctggcaacaatatggcaatttagactcacttaaccgggtgacggctgctaatgccctcttaaatcagtcactgatgcccaaagctgaacgtgaggccctgaatgttcgaccaacgggttggcataacaaacgcatcagtagcggttggctttacaaccgcagtcatctgattggctatcaattaacggggcagaacaacaatatcaagaacctcatgaccggaacccgttctttgaatgaccctgaaatgacgacctatgaaaaccaagttgcggcctatttgaaagaaagtccgaaaaactacgtccgctatcaagtgacccccattttcaaaggtaacgaactgttagcccgcggtgttcaaatgcgtggtcagtcagttggtagcaatgctgtcagttttaatgtctatattttcaatatccagcccggtatgaccttgaactatactgatggcactagtcaggtcagtcactaacgatcattgatcatcgtattcagcctatcacgcagcagccacaaaagtgatagtgccctgtcgaccagaagttcaacccaagtgaaattttaaaacaagcccaacagacgtactatgcgacgttctgttgggcttgttttgacttgcttaatccaatcacggttacgcctctaacgccaagtcaccgtaatcatacggcggttgatatcaagttgcactaacaattagcctaagtataaattctcagtaatcgttatatgcgtggtcatgcacgtgatgattcgcaccaaaaccacatccagagataaaaaaagaccacaccccatagtagggtgtggtctgatgacgttccgttaagtaaataattacttaagggtaacgacaccaccaacttcttcaagcttagctttcatatcgttggcttcgtcttctgaaacgccttctttgatgattgaaggtacgttatcaacaagacccttagcatctttcaagccaagaccagtgatatcacgaacggccttaatagccttaaccttttggtcaccggattcagttaattcaacatcgtatgaatccttagcagcggcagcgtcgccaccagcagcaccggcaacagcaacaggggctgaagctgagacatcgaattcttcttcgatagccttaactaagtcgtttaaatctgagattgaagcttcttttaatgagtcgataatagcatctttatcaaaagccattttttgttcctccattttatatgaacttatattttagtttttttaacacactgacagcaaattaagctgcgtcttcgtcgcctttttcagcaaccgccttaacagcgtatgcaacgttacgaacaggtgcttgtaacaagttggcgatcgtagccaataattcttcacgtgatggcatcgtagcgtattcttgaacagtttcaagatcagcaactttaccttcgatcacgccaccctttaattgaagggcatcagcggtcttcgcgaagttagccaagatctttgcgggagcaactgggtcttcttcagagaaggcaacggcagtaggaccagcaaatacaggttttaagtcttcaaatccggccttatcagcggcacgcaccatgatcttgttcttgataacgcgcatcttaacaccggcttcacgtaattgcttacgtaaatcagttacttgttcaacagtcaaaccacggtaatcaacaacaatggctgatactgagctcttcaattgttctgcaacttcttcgacttcttgtgctttaacagcaattgtttctttactcaacagattcacctcccagaattttggttcagggatttataaaaaaatccctatgtccaccaagacatagagaaaaacaatgtcctcggcgggtagattaaggccgttaagccgcctgagtcttaggtagagatattacttaacctctagtaatctatcacagatcacccacggggtcaattgttttcagaatttaatccttaaaatgatgctaaatcaacacgtaccgctggggtaaaggttgaagtaacaactaagttttggatgaaagtcccacgtactgaggctggacgagctttcacgatggtgtcttcaatggtcttgaagttaccaactaacttgtcagtatcgaatgataccttggccaacaggaacgtgaacgttaccgtcacggtcagtccggtaagtcaccttaccagcttttgaatcgttaacggctttagcaacgtccatcgtaaccgtaccagtcttagggttaggcattaagcctttaggtccaagaacccgacctaaacgaccaacttgggccatcatgtcaggggtagcgattgcgacatcaaagtctaaccaaccgtcttggatcttctgaactaaatcagtttcaccaacaaagtcagcaccggcttcttcagcttctttagccttgtcacccttagcaaaaacgataacggtttgatctttaccggtaccattaggaaggacaaccgcgccacgaagttgttggtcggcttgctttgtatcaacgtttaatttgaaggcaacttcaacagttgcatcaaactttgcgaaatccatttttttaaccaagtctaccgcttcagttacatcgtaagctttgtcacgatcaacgagcttagcggcagtcttcttggtattgtttacttttctttgccatctaagtgttttcctccttgcaaatgtggttcaaacggagatttcctcccacttgacacattcattttgatgaagtgtccgacatactcaacagtactgaattagccttcgacggtgaatcccatactccgagcagtaccttcgatcatgcgcatagctgcttcaacgtcagctgcgtttagatcttgcattttagtttcggcgatttgcttaacttgatctttggttacagttgcaaccttcttcgtgttaggttcaccggaaccactttcaacaccggcagctttcttcaatagaacggcagcggtggggtcttagtgatgaagtcgaatgaacgatcttcgtacaccgtaatcacaacagggatgatcataccgcttgatcagcagtacgagcattgaaatcctttgtgaaacccatgatattgataccgcttgacctaaagctgggccaactggcggagcggtgttgctttgcccgcgaggaatttgtaatttaacaacgttagctactttttagccacgagacattcctccttagtccgtgatgtggtaaatggagctgagtttttgctcctcccacgtaaacgtgcatacgtgacgcacaaacatcattgtagcatatctatttttcaccagcaaccttttttgtggcttctggatataaaaactggacgatttggcgatcaacttcatagttttcatgtaatcgtgaatggcgggcattcttaccatgtaccacaaattcttgatactggtcacgcgtcggtcgcagtaaaaagcgcaatgacaacgcactattcagagcgacagcaccatcactttgcgccgcatcgccaatgttacccgcaatattcaaatacgaaatcgtgtttggcaatcgttggagcgttcgcaaaaaataattataaacgggcgtggtcttagttggtccggtcgccgtcaacgggtggttttcaatcggatacgtattctgcccgacctcactatcattaaacggcgcaccaattgtgacaaccttgcggacttccggtaaattgaccagtttggcagctgtcgtcaggtattgaaagagcaccacaccacccatcgaatgagcgactaaattgatcgtctgaacgtgctcatgcgcaatcaaatactgcacaactgccaagacgcccgccgcctgttgccgtacagcaacgcgtggcgtggcaaaaatcaactgtaccattgggcggtaagcgtctagctcaccagtcacatggggatgattatgtcgatcaatcattacgactaatgacttattggcgatgcccccggccgtaaaacgttggagcatgccaccaaaagagaaccggttgcccgcataccctggaataaatagcgtcacggcgctatcatctgctgaattagccgacaccgactgccgcaaatgctgcggtcgcccgtattgccaaaatttaaaggtgatacgccccaaaataccgagcactaaggcgccgatgatgactaaaattacttctgccaagatggtccaccagcttacttaaattaattaccgaatctggtcaacttgatcgaagtccaattcagtacttgtttcccgaccgaacatattgatattaaccttgagcttcatcttttcgttgtcaatttcagtaatttcaccagaaaggccagagaaagcgccatcgatgatggtaacttgttcgccaacttcaacgtccaattcggtatgccgagcactcatgcctagttgatgcaagatttgttccgcttcttcaggcaacaatggcgttggtttactaccttgcccatgtgatcctaagaacccagtaacacctggcgtattccgaacaatataccaagcttggtccgtcatgaccatttcaaccaaaacgtacccggggaagatcttcttcatttcaactttgtctttcccattcttgacttcatgagcttcttcttcgggaacaacgacccggaaaatattgtcttccattcccatagattgaatacgggattccaagttagaactaaccttattttcataaccagcgtaggtatgtaagacataccatcttttctcaacagactcgaccattattattctcctttaaaatgtcttttggcaaaataaaaaaacctcgtttgcacgaagttttctttcaatgccattattataacaaaaatttgttcaaaaagccattaatgccagcttgttaacatttgtaataataattggataatccaatcaaataaagcgaaaaacgccacgaagaacagtgatgttgagacaactgtccacgaatcacgacgattttcccgccaagttggccaggtcactttttttcatttcatgtccaacttgaccaaaaatttaaataagcgcatgtctaatccccctaccgcgtttcacgatgaagtgtgtgtttaccacaatatttacaaaatttcttaacttctaagcggtcagttcgatttcgggttagcatcaatcgtgtagttccgcgaaccacaaacggtacatgccagtgcaactttttttctgtgccatcgacaaaacctccataataaatcaggtataacattagcatggaacttttcgaatgtcaatttcaggcagtgtcttgtaaaaagtcacgcatcttcttgcggcatcgatccgtggcgttgaccacttgatcaacttccacttgccgactcaatgcaatccgttctggcgattgccccgccaatagatccataaaaaccaatccttcaaatgccgaacagattgctggaaaaatccgcacctgctcacgaacatgaaccacatcaagggtcgaggcccttagcgtctgaatattgcataagatatcctcatcattaacatccagtgataagatatccccttccggacgacgcttgcgagcctgtgtccgccgaatatgatcaataatctgattactcaatagcacccggtaataagtgccaaagcctacattgccgtagccgttgatactttttagccgctcgataaactgcaattcgaccttcttgaagccaatcatcctcgtcaaagttccggacatagtattgccgccgcaaccgccaaacaactggcacacactgctgggctaatgcattaatgcttgcatcatcaccatctgctgctaagtggatcaattgctgttcattcacgtgacattcctcgcttctgactagtttcagaaactgcacccctgagcatctgtaatgctaatataccgggttaattgtgccgtcacaagcgaacgaacgtttcaattcagccacctcagcactcacagaaatcttcttatacgcggctatcaaaactactatgatcgtcccattcatcaacctaatagtgctatatcgcactaattattagtaatatcaaaatattgctaacgccaaagacaagtgcgacctacttaagcccgttggagacgagtacgcgcgtccgctggagttgcacgaagccactacgctgtctaaccaaccgattaatgcaatcgccagcgcaaactccgataacactaaaactgttatgacaagccatcctaacatctagtgaacagcagctgaactggggcatttgattactagatattttaatactagaactgctttcgagccttaaattgccactggttatcttttgcaaaatttaaatattaattatgacgatttagaaacagcccacgctcgcggcaaccacctaattacgacctgtgatgatgtttaacgtgattgcgttctagttgttggcggtactgatccaaggccgataattgatcatcattccagggtgatttacgaacggcacctaaatcctgggtgcgcacggcagtatgacgcacatctttcagcgcagtcttgacgcggtgtcgtaattccaaggctggtactcgtaatgcaccttccgaaaagattacccattgttctgcctgatcactagtcgcaaccgtcacttagaagtactactcgcgattgcttttcacccgcgtacttttcgatataactgtcagcggtctggtctttactcgtccaaataatctcaagatcagcttggcgataactcttagaattacccggaacgtacatcgcatcaaaaaccaggctaatattaaggcccgtaatttttttatactcagtcaacatgctaattaactcgtcacgagcttgcggcaaccggtccgtttgttttaaatgattgagttctggccagttgccaatcatattgtaagcatcgacaatcaataattgttgtttcatcttattttcccagtggatgccgggacgtgtagccttgataaatcagaaggctggccgccacactggcattcaaactttgaacatgaccaatcattggaatggtcaacatttcgtccacactcttcttaagtaatggtgaaattcccttaccttcattaccaataatcaaaccaacggcaccggaagcatcccactgtcggaattagtccgtcccgttcatatcagtcccaaagatccacagaccggcttcttgcaattgtttaaccgtttgaaccaagttcgtcacccgcgcaactttcacgtgttcgatagcccccgttgacgtcttggcaaccgtactggttaaccccacggcgcgccgtttcggaataatgatgccatgggcgccagctgcatcggccgtccgcataatcgaacctaagttatggggatcttcgatattatccaagatcaagaaaaatggcgcttcattcttagccttagcaacagcaaataaatcatcaatggtggcatattcaaaagcagccacccccacagctacccctgatggttggcgttgtcggttaaacggtctaacttttgtttcggcacgtactgtacgatcaaattacgtttcttcgcaatcttggcaatgtcattcagtacatcggcctgtagaccgctttgaataaagactttgttgatctgttgatcactcttgattttgctgccatggcggggtgccgcccgattacaaagtcagctgctgtttggtcttgttcgttatttgacactggaaaccctcccttcatcaacttgtttaatacaccactgtgccagttctgcaattcggtccgcccgctgagtcaattgtaaatacccaaaaacggcttcaaaaccggttgagatccggtaagtgacgacatcggtatgtttggccgacgtatgactcttggcattccgtccacgcttaaaaacgtccacttcagttggcgttaaaacttcttcggctttgcatccgttcgatcagtgccgcttgcgctttggctgaaacatagtgggtcgcgtggtggtgcaacttagtggctttagtaaaaccactttcaatcaaatgttggcgaataaacggttcatacaccgcgtcaccgaggtacgcgagtgcaatcccgtttaattgttgataatcaacttgcatattattcctttctaaaccgcacaccctgaggcgtatcttctaaaataatcccctgagctttcaaatcatcacgaatctggtcggccttagcaaaatccttagctttacgagcagcttctcgttcatcgatcagtgcttgaatcgcgtcatcagccagcgtcgcattagccgtttcaaaagtgacgccgaagacgccagtcaactgcactaatgccttctgtaaggcaatcaacgtctcttttgaaccgttgcctgggctgcatagacattggctaacttagctaattcatacacagcagccaccccgttttgaacattgaaatcgtcatccattgcggttccaaagttagtgatgagtgtctgtaactgttctgccaccgcagtatccgtcccgttcgtcgcatcttgcaaccggaacgtgagattacgataagcattacgtaacttatccaagttattagctgcttcgtctaagttggctgcgtatattgaatcggtcgccggtactgggtcgtcgccatgaagaaccatgtagcacttgcggatcaaccgttttaataatatcgtgaaccgtcacaaaattacctaatgacttactcatcttttcgttgtcatcgccaaccgtcacaaaaccgttgtgtaaccaataattggcaaacgtcttgccggtcttcgcttcactctgggcaatttcattttcatgatgtgggaattcaaggtcctgaccaccaccatgaatatcaaacgtatcgcccaagtacttagtagacatgaccgagcattcaatatgccagccgggccgacccgcaccccatggcgattcccatgaaatttcaccgggcttggctgctttccagagtgcaaagtcaattggatcttctttacgatcggtttcttcatcggcagtatgctgactggcacccacttctaaatcatcgattcgctggtcagataactgaccatacttttaaacttccgtgcgcggtaatatacgtcgccagctgattcgtaagcatagcccttttcaatcaaatgcttgtacaaatgcaatgatttctgggatattctcagaggcccgcgggtgaaccgtcgctggttcaatattgaccgcagtcgtatcttccataaaagctttaataaatcggtcagcaactgctggtaccgtggtgtgatcttcagcggcacgtttgatcagcttatcatccacatccgtgaagttggagacatagtcaacgtggtaaccgcaatattcaaaataccgtcggatagtatcaaaggcaattgcagaacgcgcattaccgatatgaatatagttataaacggtcggcccacagacatacattttcacgactccggggtgataggcttaaacggttcttttgacgcgttaacgtattaaaaacacttaacatattggcgacaactcctttcaattgaatcattacttttgatgatagtttaccatgtttgaaacacaaataaaaagcatccctcgcacggcggaaccgaaactccaccatacaaaagatactttctcatatgcagtcacgcgccactgggtaactttcgcgatactgagataacgctcacccggggactagcttgctgaccgcacgatgtattaattgcgttgtcttgctgacgacgaccgccacttacgacaaccaactaatattttaataatccattcattacttggcgagttccgcaatcatagcatcgagatgctttttggtcgtttcacgccctaataattcaatcgtttctggtaattctggcccgtgcatttcgtgagaaacggcgatccggatcggcatgtataatgcccggcccttgatcttcgtatccttttgaatgctcttgatcgtcttttgaattgcggttgcttcgaagacgtcaatatcttcgattcgttgccggaattccttcaagacagggagtgccgtgtcattatcaagttcggccttagcttcatcattgatatcagccggaccattgaagaagagatctgctaaatcaacgatttgaccagtatagctcatctggttcttaaataatgaaaccaacgtccgtgtccattcaatctggctcatatctgggcgttgtggtaaccggccagccttgatcaattggcgaattgacattgcaaagacttcattttcgtcagccttcttaatgtactggttgttcacccattccaacttcttgccatcaaaagctgctggtgacttgctcaaccgcttttcatcatacattttgatgaattcgcgcttactgaacaattcactttcgccaactggtgaccatcctagtaggatgatgaagttaagcattgcttctggtaagtaacccaattcacggtattgttcgataaattgcaatacggtttcgtcacgcttgcttaacttcttaccggtttcggtattgataattaagctcatgtggccaaacttcggtggttgccaaccaaaggcttcataaatcatcaattgcttaggcgtgttggcaacgtggtcatcaccacggaagacgttggctaatttccatcatatggtcatcaacaaccaccgcaaagttgtacgttggcatcccgtcacgcttcttgatgacaaagtcgccaccaaccgtcttggattcaaacgaaactttacctttaaccatgtcatcccaagcataggtcgtattttctgggacgtggaagcgaataacgggttggataccagccgccttagcagccgcgatcttcgcctgtttttcgtcttccgtcatgccagcaaattcgtagacgtagtgtggcatttccttacgcgctttttgagcttcacgttgtgccgacaattcgtcttccgtcatgtaagattcgtaagctttaccttcatcaattaattgttgaatcaacgggtcatagattgatttccgttctgattgacggtaagggccaaagtcgccacccttatccggaccttcgtcccaatcaatccctaaccacgtcaaattgtccatctgactcttttcaccgtctttaacattcccgctttaaatcggtgtcttcaatccgaagaatgaactttcccttattatgccgggcaaataaatagttaaacaatgcagtccgagcattaccaatgtgtaaatggccagttggacttggtgcgtaacgcacacgaatcttgctctttgccaatgtgattaacgcctctttcgtattttttcatcttaaatgttacgccggaacctttctatcgaccagaatattccgactttcacttgcttttccagtttaccatgtttaccgctaaaaattaaggtttcagactgaacccattgtaaaaatatcgaaacaggccctaatcgtacactaacaacatcccaatttattgataatgagcattaaccctcctattttgttgcgattcggccgcctcccttacgacgtcctggattagtcatcattgaacaaaaaaacggtagcccccatcaaatgagttgctaccgttgaatcgcttaacctagtgccgattatcgcgattatgttatttcgattattactatgattattgttgtgcttattatttccatccgcatgatccggaattccgcgattagcgtgcgctaaacgggcaaaaatcattcgaccagcatccgtttgtaaggcgctcgttacaacgacatccaccttttcattgatgtaaaacttcccatcttcgacgacaaccatcgtcccatcgtccaagtaaccgaccccttgttggcgttcgctaccatttttgacgaccatgacattcatctcttcaccaggaataacacgtggtttcaacgacttagccaactgattaatattgagaacttgtacgttttggaactcaatcaccttattcaagttgtagtcattcgtcacgatcacaccgttgactttttagccaattgaatgagtttactatcaacttctggaatatcctcaaaatcgccctcgtacatttcaaccgggataatattttcattttgtagcttatttaaaatatctagcccgcgacgaccccgcacacgtttaatactatcagctgaatccgcaatgtactgtaattcatacaagacgaagttcggtactaacagtgtcccttctaagaaaccagtcttgacaatgtcgtaaatccggccgtcaatcaagatgttggtatctagaatcttataatgatgatagttctgatctggctgagcatcagtaatctccggacttgtttccttttcacgacggcggaagttgaaaactttccgccactcgtcgatccgggtagtcccgactcgcgcaccaatgtaaccaaaaaacaacatcaaaataattgggacgaccgtgttcaataggaataatggactacgattaaataattgcgaaatcagaaccgcgatcaataacccaataataaatccgatactgccaaataaaagtgtcattggattttgcttggataagttcttttcgactcgatccaccagtcgtacagcggcattggctaagaacaatgacaaaacccagctagaatcagcgcccccaacaaaaagttggtaaaaacgttattcaataacacatttggttgcgacaaaattgtcgtccacaagaacggcaggtaagttagtcctaacgtacccccgacgacaataaatactagtcgcaccgttaacttcttcatggcatcagcccctttttaataatttggttgttgtaatgctaattggagcgcttcttttagcgtggcaactccaattacttcgattccagttgggatatcccaaccttgcagattattcttaggaataaagatacgtttaaaacctagcttagccgcctcaccaactcgtgattcaatccggttgacccgccgaatctcaccagtcaaaccgacttcaccaacaaaacagtcactcggacgagtctgctggtcacgataactagaagccacactgaccgcaatagctaagtcaatcgccggttcatctaacttaacgccaccggccgctttcaaatacgcgtcctggttctgaagcattagactcgcccgtttttccaacaccgccataatcaaggagactcgattatgatccaagccacttgcggtccgcttcgcattaccaaagaccgttggcgttaccagcgcttgaacttctactaagattggtcgtgttccttccattgaaacaacgatggcggaacccgtagcatccttcagacgttcttccaagaagatctctgacggattggccacttcatacaaaccgcccgtccgcatctcaaatattcccagttcattcgttgacccgaatcgattcttgactgcccgtaaaatgcggtacgtatgatgtaaatcaccttcaaagtacaaaacggtatcaaccatatgttctaagatcttaggccccgcaatggcaccacccttagtcacatggcccacaataaaaatggtaatgccgttagtcttcgcaatttgcagtagttcagccgtaatttcacggatttgtgatactgaaccaatcgcagtacaagtccatatcaggttcttgcatcgtttgtaccgaatcaatgaccacaaattctggatgcgtcgattcaatcgttgaacgaatattcgacatatcagtctcaggataaagataaaagtcttcactgctaacagccagccggtccgcccgcatcttcacttgggaggcactttcttcaccagtcacgtatagtacggaaccacccgtctcggccaattgccccgaaacttgcagtagtaacgttgacttaccaatacctggatcaccaccgatcaaaactagtgaacctggcacaacaccgccacctaagacccggttgaactctttcagcttagtcttgacacgcggtgtcttagtcagcgacacttctttgagtcgttgtggcttagccgacttacccgcaaagctcacccgcgacttgcggtccggttttgtatcaaaatgttcttcagttagtgtattccattcaccacagttcggacaccgtcctaaatatcgcgggtgttgaataaccacagttagaacaaacaaactgagtttttgcttttgccacgtacacacgtctccatttctccgccaacatatcaatttaatgttgggtattggaatttctaaaataattacttcatccgcgtcacactgtcatgagtcatgattaaaacgtgccgtttttaaatttaaaagcagccagcttaggcccgctggaaacagtccgggttagcgtaaacttgcttagttaattcgtcctacaccgacctccaggcatttctgccaattgccggaacgcggtgggcacagatttgagccgaagcccacgtcttaaatactggcctttcacgcttttatgccatattggtgaaacgtgttcgggtcagactgagacttcacactcttgcagtactgggcattgtcagaaacaccttccagtcgggatggtattcgaatagctgatgaagatgtactcaacttttgatgaattggtcgttgttttcataaacggtaaattttctcaatcaactgtcaggccgaaaatgatattgtgatgacttactatttctgagttaccagtcataatacattgaacgtttcgacaaagtagagaatacattctgatgtttcgctcaaagttttcgtatcaaagtagtcagcaaccaattgtaccaagttaagcggccgtttatttgccattcgagcgacttcccggctggaggggctgggtgacaatgctcagtagccaaattattcttaggcggaagtgtctttcttccggcttagaataagactcgtatttgagatgacgcgggttatgcgttagctcaaatcgacgtcggcttacgttccagcaattgtcacccagtcccggaggtcggaataggatagtcattgcagacgaacagaaatctatctaattggcaccttttaaccatgattcttactaaacaaccagccagtacgatgcagacttaaataatcaatcaaactcaattaactggatcgtcattttcatgctatgggtataagtttattttaccattattaatcattaaagcctttaaatcaccttggctttaccgattttttattatttcctatttattggtcgaaccgaagcccccagaacgtgtcgttgtcacattcgtttcatccgtaacagtcagataaggggtaaaaatcccttgggcaatgcgttcaccctttttaatgtgaacgtcgcgaatccccatgttgattaattggacgaaaatcgcaccttcgttcttgggattgttatagtagtcggcgtcaatgacgccaatcccattcggtagaatcaagttacgcttcaaggggttgctggaacgattggctaatagtaagtattcaccatcattcataaatgccttaatacccgttggaacaagccatggtttaaggactttagccgccgcatccaaatcggctgcagaactcgtttcaccatgatgtatttgccaaagtactttgataaagttcatttttccaaattgacggtaacgtaaaatcttccgccgcttcgaagtcatagccagctgcttgcttggtggtgcggtaaggtacgtgtaaccccgccgcgcgtattgacttacaatttcaaatccccgtgccatttcaaattcctactttctcaacattaatttagtgttcacattttaccatacttttattatagaagtttcgttgacaaaacgggcaattaccggtttaattacggtagatataaaaccctttacaaggtggtgaaatcaatggaattcacgcgtgaagcacaccgcttttattttaatgacgatcacggcaagttggctggtgaaattaccttccccgccatcaataatgatcagacctgggtcattgaacatacctttgttcgtgacgattttggtcatcagggcattgccggccaattaaccaaagccgttattgacgccgctcgagttgaacacaaacgtattcagccactgtgtacctacgctaaggcacttactttgatcggcaccctgaagctgccgacgtattagtcactagttctcaatcaaaggagtaattcatattatgaatcaggatcagttaaaacaacttgttggtcaaaaagccgttgaatacattcaagacggcatgcgggttggcctcggaaccggctcaaccgttaaattcatggttgatgctctgggtgaacgggtcaaaaatgaacatttaaacattgtcggcgtctcaacctccgaccgaaccgctgcccaagctaaggcgctcggtatcccgatgaaatccgttgacgaagtcgaccatctcgacttaacgatcgacggtgccgacgaaatcgccgatgatttccaaggcgttaagggtggtggcgccgccttactcttcgaaaaaatcgttgccatcaattctgataaagtcatgtggattgttgatgaaagcaaaatggtccatcaattaggtgcctttggcttacccattgaagtgattccttacggccagccaacatgtctttgaaaaatggctgcccggggctataacccagtattccgtaaagtcaacgatgaactcgtccggaccgattctaataatattatcatcgatttacacatcgacccaatcacggatccccacgctttagccgaagatttaattcacatggttggtgtggttgaacacggcctgttcttagacatggtcaacactgtcattgtcggtcatgccaatggtcccgaggttatcgaagcacgaccatagttttgtgcgactcccggcttgccccacccgtcataaaccgatacaattagaattagattaaaggagagtgatcttttgagtaaagcaatcagtatgaaccaaattgctaactttcaagccgacttggaccaacgtcccgaagcaaaagtcatcgaacgtagtgtcactaagaacggtatcttagcaagcagtcaagatattcaggccatgagccaaaccacaccagtattttccattgattttggatacaggtgacgttgcgaaccaaaagcaaagtggccgttgctggatgttcgccgctttaaacacgatgcggcattcattagctgaaaaattcaacttgaaacatttcgaactatcacaaaactacacctttttctgggataagttcgaaaaagcgaactatttctatgaaaacgtgttggcaaccgctgaccaaccaactagcagccgtaaagttgcctggttgatgaccacgccacaacaagatggtggccaatgggatatgctcgttgccattattcagaagtacggtatcgtgcctaagagtgtcatgcctgaaacttacaacagttcaaaatcggctgaaatcaacagcacacttaacttaaagttacgtaaagatgccgttgaattacgtgaactagtggctgccggaactagtgacgacgcgattcaagaacgcaaggaaaaatgttaaatgaagtctatcgcatgttagcctatgcctttggcgaaccgccgtttcacattttgactgggaatatcgtgatgataagaaacaataccacatcgaccaaaacttgacgccacaaagcttcttcgaaaagtacgttggctggaatttggacgattacgtttcaatcatcaacgccccaaccgacgacaagccttataaccatacctacacgattgaaatgttaggtaacgtcttaggtggccgtgaagtcaaacatttgaacgtgtctatggccgacttcaagcaattggccatcaagcaattacaagctggccaaagtgtctggtttggttgtgatgttggtcaatcctccgaccgccaaaaaggggtcatggctaccgatgtctacagtaaagatgaattattcgacgttgacctttcaatgtcgaaggctgaacgtcttgattacggcgaaagtctgatgacccacgccatggttatcaccggtgtcgacctcgttgacggccaaccaactaagtggaaggttgaaaatagctggggcggacaaagttgggactaagggcttcttcgtcatgagcgatgcttggatggacgaatactgctaccaagttgttgttaacaaggaattcttgtccgatgacttaaaggcagcccaagccgaagaaccaactgttttagcaccttgggatccaatgggtgcattagcctaattaagtttaatgggccatctaaattaagcaccatcactgctttagcgtgatggtgcttttgactgcattagacttaactaccgctcaaggaactactaacaacaaacaataaaaaaatcgactaaactcacgcgagtttggtcgatttttttattattacgtttacttatagcaatcactattataattatttatacatctgtttaagcgtactaatttcacgagtcgtaatatgtgctgctcgatgcgactggtaatacatcaccgcactcttgttgttctcgtgctctagtcccagtgcatgtcccaattcatgggtcgcaacggacagctttatattctaccgaatgattgctggctggaaagcgattcgtgtaaatcacacacttcgccgaatccatccaagttgttccttgcgaaccactttgatagtacgtccgccaagtccggccgatttccgatccggtcgtctccgtctcgtcttcactctcgcccaacgtaatctgggctttcgcttggtccttagcctcaactaacctcaccgcgttagtgttattccaacgttccacggctcgtagccaaatcgctcgatacaccttgctgtcactcgtgatccgatacgtgatgacccgactcttaaaacgggccttatagttcaaaaccttagtccgttatttatataatcatattgatagttatccatctgatcattgtagtagacctgatcatgcgtcgtatcgtgaccactagccttatccgcttcaactcgcgacgcattcgggttgatcagcgtactgatttgtggcgcgaacatcaacagcatcccgcagaaaacccccaagctcattataattaataataataaatttttatgtttcatcataacgttacccggctttctgatcagatttttggctgtcaagcgcgccaaatcgcaactttgtccaactgatatgttacagcgttcaccattctattacaagttatatattatatttatttatgaaaactgaaggattttattacattaaaaatatttatattaactcaagcagttgtgaaagcactgttatatcaactttttaagcctgtatcattttttgagcactcgtcggcaattattatcaatgattataattacttatactgggcatttatttaacactttaactaaaaaaagagcttcagcgtctgctgaagctcttaactcaggctcgattaatctgataatggtctaaaaaagcagtccagattagcacttactttaaataaaagtaccgcttaggagaactattactaaatttaatactcttctttaccgataacgtgcagttgctgaccgatcaaggtgataacaaattggcactccgttagcaacttcgacaccatcaatcccagtatcactaatatgctctaaatatttgatcatcgcacgcaacgtactaccatgcgccaccacgagttggttttggccgtctaacaaccgcggtgcaatctcatcgatccaataaggcatgatgcggtcgtaagccatcttcaagctttctccccgcggttcgacggcggcaccgtacttggtgtaacgtcgatcatggtctagttcagctggtgtcaacaacggcggcaccgtataaaagctccgccgccactgttgaacttgcgccttaccgtactcttgacgagtcacatccttattttgaccacgtaaggcaccgtaatgtcgttcatttaaccgccacgtcttatactcaggcagccataactgatcaatttcacttaacataatattcgcggtaacgatagcccgttttaggactgaggtatgcacagcgccaaactgcagtcccgtagctcgtaatcgcttgccagcttgatgagcctgtgcaatacccactgctgttagcgggacgtcactccaaccggtatacgtattatcccgattggccgtactctcaccatggcgaaccaatactagttctgtcattctctttcccacctactatcttcaatacttcctatgataatcgatttggttcatttttcaaagtcacaaccagctgttacgtgcgataacgcgcttgccacaaaaaaacggtcaagctgattaatatcaccctgaccgtccacgattaattaattttcttgatttgaaacggcgtgcgcggctttgatgacatgttcatcatcagtggcggccgctgttggctgctcaatcgcacccatcgtatcccgttcacggaaccgattaccaacaaaggtcacgacggaaccaatcaaaatcacaacaattccgaccactgtcgtccacaaaatttgttcatggaggatcaacgctgcttaagattggcgccaaccccggcttaatgaagaatactagggaagccgttgaaacatcggtttgttccattgccaagaaataaaacgcgaagcccccaccagtaacacaaacgccgataaaaaatagtaaccagaaatagttgagattaacattcaccaaaaccggaatggcagcaaattgccgcaaaccgatggccgtcaacccattggcgacagccggaatcttagtaatccaagctaaaactagaagttcaaacgcaccagcaaagaaagtaaaacaagtcatcgtcagcccattcaagccccgtttaacagacccataacgcgagatgatactgtacagcccaaaagtcacggcagacccgatggctaatagcagcccgagcccattcgtcaaatgggccggattaacaatgatcaacaacccaatcacagaaatcacgacggagatcaagttagctcgacccaaccgttctcgcagaattaaataggagaataatagcgcaaataccggattacaactaaacaatacggccacagtcgaagcttgatcgaccgtaatcgcgagttggtaaagcgacatactgacaatgacacacactagcccggttaaagcaaatagccgccagtcagcactcactaactttcgtccggtttgctttaatgcccgcaatgcaaatggcagtaacacaattgccccaataaaaatcgaattagattcaattggattgggttaaaggcactgccggccatctttagcgcaatttccatcgaactaaacattaaggtcgaaattgcaatgtaaagatatgctttcttcacgaaacgttcgcttccttcttaatcaaaatttaatacgcaacggttctcagtatagcaccattttcacgtgattttcaaatcagctcagtatactacctcgcttttatccgcgggaaaacgccttttaacgtggaatcaggcgttatttttttcaatttttaattgcttttgaaaacaaattttcatcaggcttgaaccattcaatggcatcttgccgcctcaaccatcatccagcacgcactcatcagcttgtcatcaaaaactaccagcgagacgtgttgggacggccctgagcagaaagtatctaattggtcaaaccttgttgaccgaactaaattgagttttcatcattaacaaccagcaaaaagcacccgcaacgcctgtcactagcggcacgcattcgggtacttttaattttaagtcacacaataattaacgaataaaattggcttgaacgatcaccatcaaaatcggaataacgatcaggctcaatagtgtcgtttctgtcaccatgaccgcggcataatcggcatccgccccgtacagtttggagacaactggtgcgttcgtcatgacgggcatcgcggactgcagaatgaagacttgcttcatctccaatggaatcgacattggaataagcatcagcgtcatcagtaccggcgcaaggataaaacgcccaaaagtaaaattcccaagctatcccggtcgaagcgcatgctgcttaacccggcgttggccattgaaatcccaataaagatcatggacagcggaatcgttagaccgccgatatatgagaaatcatccatcaagaattttggaacgtgaatgtttcctagaacaagcaagacaccaatcataaatcctagtaatggcggtgagaagatcttggtcagtgtctgcttcaagtcaaacttagcggtgccagtaccgtcacgttgaatcaaataaacgcccagcgtccagaaaatggtggtattggccatgtaataaactaacacgtatggcaatgcgctattcccaaacaaggcttgattaaccggtagcccaataaacaccgtattggagttcaaaaacatggaggcaaataagccgcgatgactctttttaatatttaaggctcgcatcaccccgaacgaaatgccaaacaaaatagccatattaagaactggaaaacgtaagtctcctggcaacgttgataataatttatgcgctgtaaactgctttgtgatcgttgcaatcatataggctggtagcgcaatttgagtgaccaatcgggcaatcagcttagtcgcactttcattaaaccagccccagcgtgccaacaagtaaccaactgcaatcatcacgatgatcgtcatgacaccttgaatactctgcacgaatgtctgtaaaatttgcacgctcagtcttcccctcttaacaaattgctcatcattgaatatcgctatcaagctatgtaaaataataattcaatgagaattattcaagtataccactgttttatgatggcttgtaccgtaatttatagatggaaacgtttgacgccggtcacaatattacttatagtgttctataattgtgttactactgatgccagtaattttttgattattaaaatctttttaaattactaactttaaggaccaatgatttgctaaacgtcataaaatgactattgagggggaaaaatctaaagtgatgaggaacgaatatgtcagaaaataacaatgataatgaaatgggaccacgccaacgccgctatcgtgaacagcaacagcgtaacccacatttgaaaccacacaaaaaacgtccttggttaattactttactaatcgtcgttgtcctgttgatcgttacgggtggctggtggggctacaagacctggaatgccgctaaggatacgatgaatacgacctaccagtcgactggctcgaccaagcttcggaatgttgatgccgttattaagaagggcaagccattctcgattctactgttgggaactgatactggtgcactaggtcgcggcaaggacttctcggcccggactgataccatgattgttgcgacaatcaatcctaaaaaaagaaagtatgacgctcactagtattccacgggatacgcaagtgatgatcaatgggcaatcacaaaaattaacgcagcctacaccattgggggcgcaagtggtgcccgtcaagtcagtggagaagttactggatgttccaattgacttctacgtcttactgaacatgggtggtttaaaacagatcatcaacgcgatgggcggcgtgaccgtgacacctaagctgactttcaaatacggtaatgccaacgttaagaagggcgttaagatcaaacttaatggtgcagcggcacttgattactcacggatgcgttatgacgatcctcagggtgattatggtcgtcaaaaacggcaacggcggttattatggccatggttagtcagtctaactcaattggggcaattgccaatattgaaaagattacgaaaaactcgctaagaacatgcgcaccgacttaacttggaatgacatggtcgcactcgatacgaagtacaagaatgcgtctcaccatgccaaatcatataccgttcaaggtactgacgcgacgatcgatgggctctcttatcaagttgcctcttcgtcagaacgttacaagaattcgaagcgcatccgtaaagcgctgggactctcaaacagtaatttaacagagtcagtcttctctgagacagcttcaattacaacgggtagctcaagttccagttcaagttcatcaagtaccacaacgcctagtgataccactacttatggcactagtacgacacaagatacaacgacgcaggaccagaccacgactcaagatcaaaccacaactaatcagtactaagcaactattaaaaaatgggtttcttcagaataaaaattctgagaaacccattttttgatgattatttttaattgaccggccaagattgtaaaaagtgttgaaactttgtttcgcgctgttcaattagatccggtgccggcaatgcttctagtgcggtaagttgggtctcaatcgcctggttgatcgcagcaactaatgtctgatcctgatggtcaataaccaggtcaactaagccgcgcgactgcaaagcgctagctgtcattggtaataaatcgatggcgtcactgctagtttgttgcccatgtaaaatcgctgtgactgcctcgggagaagcaacgttgaaaagtgcatcatctagcatgataatgcggttggcgttggcaaaggctaacgccccaccgctatggccctcaccgagaaatacaacaacgttcggtacggtcagctgaccagtcgccgcaatcaagtccgcaatggcctgactctgaccatagcgttccgatcggggactcgcatcagcacctggcatattgattaagctaacgaccggccacccaaatttagccgcatgggttacgactcttaacgccgtgcgatagccgggaacagttaatgctccccgttttttcgacgccggctcgcaatatcaacaccccggtcaacgcccagagcagctaattggcgaccagtggcagtgcgcccaaagccagccgttaaagccgcatcctgacctaataaacggtctccccgttgttgcgtcattgtcggcaataaacgcttgaatgatagtcggcgcactgatccgatcagccgcccgtaatcgctgtaatcgtttatccatgggctgacctcccaatcccataattcgctaatgcttgtcctagcgttgaccgcaattgaggtcgttcaacaactgcatccaccatgccatttttaaacagctgatccgccgtttgaaaatccgccggcagcttgacaggcaaagtttgttggatgacccgggctccggcaaagccaatcttagcacccgcttctgcgataatcaggtcacccttaaacgcaaaactcgccgatacgcccccatagtgggatctgtcagcactgtgatcaagggtaacggcgctgctgctaaccgtgctaattctgccagaatcaaattcattccgaccaaggcataaacaccttcttgcatccgagcaccacctgaggcggtcacaatgatcagtggtagccgttgggcccgcgcttgttcactagcatgcaataagcgacgtgtagaccgccgtgtttaacgtccccatcataaaatgactatccatcactgctaagatacagggttgttgctcaatcagggccgttccacagacaacagcctcgtttaacccggtctggcgttgagcccgccgcagtttgttcgtatagtccgggaaccccagctgattgacaggccgctcagtcatcgtcaacggctgaaacgccccttcatcgacgagttgttctaatcgttgcgccgtcgtcaatcgttgccaatagtgacaataaggacattgctgataagtgccccattggcgttggtggacgtgccgaccgcacttaggcgagcttgccaggtcccagaagctggataatgactcatttcgacgcctcccaacgtgctagactgtgaatcgtgtactgatcatgaatgtaggcgggccgggccaccgtttgctgtagaaaagttaagttcgtcgtgggtcccgtcaatgttacttgcgctaaggcccgttgtaagttggcgcacggcttgctgacggttcgcaccggtgaccatcaacttggcaattaaaccatcatacatggttactagccgatcgccctgatgataatccgtatccactcgtacatcggctggccagctcagcgtttcaatccgcgtctgcttaaccggtaaggtcgcggtcaatcgagcttcgatcgccgtacacttgggctgcaagccaacatgctctggaaaatcaaccgtgacgccagccgcctgtttgatttgttcagccacaatatcaattccggtggttaattctgtcaccccgtgttcaacctgtaaacgcgtattcatttccatgaaatagaactgaccatccgcaaataagtattcaattgtgcccaagctttgataatgtgtacccgctaataactgccgggacaaatcgtataaggtccggcgttgtgtctcagtcaaaatacttgccggactttcttcgagaaccttttgcttgtgcaattggaggctacagtccacgatcaccaagaatgaataatttcgtccccgtaccgaggacttgaacttcaatgtggcgggcagttgtcagaaattgctctaaatacatcgcatcgttcaaaaggacgcagcagcttcttgacgcgcagcccgcaattgttgatggagttcatgaacgtcggtaagcactcgaatacccttgccaccgccaccataactggctttcaaaactagtggaaaaccgatcttggcggccgcgtgtttaatatccggccatgctaagccctgtaatgattgacccgctagtaccggaacggcttgttgccgtgcaaaatccttagcgcgggccttatcacccatcaacttaatttgctcagtctgcgggccaatccaggcaatgccacattccgcacacatggcggcaaaatccgcattttcagctaaaaaaccatatcccgggtgaatcgcatcggcgtgcgtattaattgcagccattagaatcgcttcggcatttaaatacgatccactggcagctgcgggtccgatacagaccacttcatccgctaattgtgtgtaacccgcatgccgatcagcagttgagcaaacggcgaccgtctgaatattcaattgttgacaggctttgataatccgtacggcaatttcaccgcgattcgcgattaacagcttgcgaaacatagctaccgatcctttcgcattgtaaataacggttgttcgtactcaacagtggcgtcgtcagcaactagtactgctgttaacgtcccatcggtcggactaactaatggattgaataatttcatactctcaatctggcctagttcttgaccagctgtcagtgactgaccaacctttaaatctggtgccaagtggaccaccccgaccatcggactcggcagtgtaacgacttcatcttcagtctccgcaactgtgctggcgggcgtagcggctacgggagttaccgtttctgaagctaacgctggtttcgtcacttcaatcctcctccaagtcgccggctttaacgcgaatttgctgataaccctgtcgcgcgtatttctcaactaatcgatctaaatcttttaattccatctgcacacccctacttcttgatcaagactgagccatacgctagcccgccaccaaatgctgttaacaacactggcccagttaaggtatcaaaaacattggctaaggccattgccaccccagctgaggacgtattaccataatgatcaacattatgtggaaacttcgtcattggtaacgccaagttagccgcaattttttcaatgatccgtaaattagcttgatgacagatcacgtattgtaaatcactgggtgtcagttgcgcactcgcaattaacccacgcatctgttctggaacaaccgtcgtggcaaattgaaaaacatcccgtccaacttggtaaaacgcatccgtttgcgggtagttcgttgcggcaacttcagtaatcggccgtactcgtccagagtgaatgaccgtagcgtttccttgcgattctaatttctcagcgatcaagctgttttcatctggattgtcagtagcttgtaataacgcgccaccagcaccgtccccaaagaagacggctgccgtccggtcctgaaagtccatcatcttggaattaacttccgcactgatcaccatcacattttggtattgcccactgcgaataaacttgtcagccgttgctaggccaaacgtgaacccagcacacgctgcactcaggtcgaacgcaaacgcattatcagcgccaatattagcttgcactaaacaagccgtcgcggtgttaaggcatcgggcgtaattgtcgtgactaggatcaaatcaatggcactggcagctaaaccacttttttgtagtaactgctgggcgacctgggtggctaaatccgaggtgttttcatcattcatcgcgtagtgtcgggttttaatcccagtatgcgcctgaatccattcgtcgctagtgtccataatggctgctaattcgtcattatcaacaacgcgtcccggaacatattgtcccatggcggttaattttgtataagttggcatttttaaacccccgctactttccgtttcgattagtttaattttatcaataaaagcctatccgtcaaagtttacggctgtatttttggtaaatccttagaaacctagccaaaatgaaagaacagtggtgcccataaccgacacaccactgtccatcataactttgttaatacttatctggcgccataaagccatttttagctaatagcggcatcacatcaacccgtttatccgtcgggactttctgcgcaaacacctttaatcccgctgcttgtaacgcatataatgcccgtgcttcggcttgaccgattgcaatagcattggtgaccatcaccatgcccgctgaaaaagctagactaccaatatcaatgcccgttttgctaaaatcaagtcccccgctactaagcgcgccatgttctggggcgtatcagttagggagattagtggctttacttcatcaaatagcgagtcttgataaatctcgatcattttgtcaactgtaatcacattagctttcacaccagggggcgcggcttgcacaattagaatcttgcgaagtgcatcctgggcaacttcgtctgagacgaccaaaatacggttaggactgaccgtcttggtccacaccgtggcaacttgcccgtggagtagccgactatcaatgcgtgctaaacgaatatccatcgtcatagcggctcatcttccccatcgtcctgtaacaacttgagatgcttaatcccaatctttccagtctcttcaaggtgggcaatcacctcatcaattggcttatcacgaacagtgtaagcctcaatcagcattggcgggttcagaccggtaatcagacccatgcgctctgtatgttcggcaacgatccgactagcggcgttaaatggcgaaccgccccataggtcaaccaagaataagacttggtcatccgcgtcaaaaccgggcaaccgcagcagctaatttatcagctaattcattaggttcttcgtccagttgaaaggtaaccgtttggaccttatcttgcttgccaaagatcatgtaggatgaatcgacaacgccccgcgcaaaactcccatgactgacaacgacaaatgctaacatctactttccctcctcagtcggttaaatctactcaataagatacatgcaaaaagcatgccaagttagtgtatcaactcatcgcgacctttgcctgatgagtctccaataattgcacaatataataattttcagcatctgagaaggttaactgtagttgatctgtcaattgctgattggcctgttgcacaagtgggtaccacttcgatgccataatgtctggcatctcttcggtgggtgccgaaatttcatctttgatggccgttcgttctagcgcacccgctaagtgcataatcaaatcaatgcgaaaagcattcgtcattacaccatccaagtgcaagcgtcgcaatcacttcgctatactcccataaaattcccgttaacttcttaggatttaaaaacgtgaagtaatcgcctaagtaccgttcgcagagttccggtgtcaactgctgactttcttccgccatggtctgtggcgaatcgatccccgtcgctaactgatcaataaacttttcgccaccaccttgtagcaattcttccaatgaaataaaagggacgtctaattcgggttttgtaatcccagttgccgcaatgatttgataattttgactgatttgttgtatccgtgtcttcatttcgaccactgagattgggaataccgtgataccttcgataaagttttgagctaataaactgtctaaaattgacttgatacgttcagccgtcccaacgccggtcgcacaaattgcaataatcgcccgttgtgccgtcttatccgtcgctaaggcgggcttgactgttgcgcgctgactatccgttggtaggttccgtgaaattcgccaggaataacctttgaaaccaacgagctcctgatacatagaatccagatcactatcgaccaggctagccttccgaacggcttccaaaacaaccggcgtggtcaccatgtcaatcgttcgcgtcgcaattcccgtctcctgctgaattcgttccccgaaggtcgttaacgaccccatatcgactagtaacaaaattcctttcccagaatcaagcttttctactcgtcgcttgacatgatcataggcgacactcgggtccatatcgagaggcatgtcgaaagcctgaacatcataatcatctaacaattgtccgacgacctgtgccatggaagacgcggtactcatcccgtgcgctgccaccaacacgccaactttgccgttaagctgcatcgattttaacgagatgagcaaaatggccagataataaacttcggacttgggaatcggtaaatgataccgttcctctaatccttgcttgagcgcctccgctgctttgatttcagccggatatattcacgcaccatcgctaacatatccgaactcatttgacgcatgggcttgcccgcctggatgcgtttgataaaggaactgacgtgcaagctcacagcgtaaataaagttatccttgaaattataacctagcatgtcttgaaccgtcatctgcgccgtcttggtaaaatcaatgacgtcctgatcaacgatctcggctaacttgttttctggtgaaacttctaactgattttgtttataaaatgattttaaatgcacattgatatcggtcgtgatgaaacgattgatgtgtttttatcaaggccttcccgtcggagtaacgctgctttatcaccaataatctcatataaattatatggtaattcataattatcgttcttattacgaagcggcgttggaccatcatttggcttcacgatgagaaccgagtccaacaactcagagatggcccccagttcgtgacggttagaggctactgtcatgagaccgctacggatattttgtggcaaatcatccatcgtgattgtgatttcactgtcattttcgatgctattgacaaaaccctgggcacacaccagctgaatgttcgacttcaactgaccgacgttcccaaatgtgactgagccaagtaaggctcgcaccacgtcctccgttaaccgaatctgtttattgattcgattagcttccaatgacaataatgccttcagtaattctaaacgttccttggctgagcgatgattgaacgctggtagctgaatcgtaatcggaattcgccgaacaaaggtctgcagtagggtactttctgggtcctcggtcgttgcacaaactaagcggacattggcatggtgactcttcgccgtctcaccgagtcgtgaataagtcccgtgatccatgaaataaaaatcatttcctgaccttctggtggtagacggtgcacttcatctaggaacaacatgcccccatccgcttcttggatcaaaccgtccttatcttttcattagcacctgtaaaagaccccttaacataaccaaacaaatgcgacatcaataattccggattatgcgcataatcggcacaattgaacgtaatcaggccttgcgggttcgttaagacttgttgggtttccgcaaaacgatacatggcgtttgcaaagtaagttttaccagaaccagtcgggccaatgattaatgtatttaatccccgcggtgggtaaagaatggccgctttcgcctgttccacttgattagcaaggctctcatgcgagccaatcatgctggcaaatatatcatttacaaccggtttaggcacagacgtcgcgacgggcgctgtcggtattcgctctgtcgtcgctccattcgctacaccactagttgttgtggccgttgtggctgttgcattcaccggaacatagtgcacaggccgccctgtcagcttgtgcaactggccttctcgcaccagtgcatttaattccttgctgacgtttgaacgcgctactcattaaagcggtcgctaccatttccgtcgtcagtccgtgtcgatcgctatgttgacggacgtattcacaaatcttggattttctggtcaacttcgccactccttttcaccactatcaaatagctgatccgttttgatacactataacacactatattctaccatagttcccgactcagttactttttaagacttgtcagtacaactatttctgtttcatggtattgaaattccatttatgacgcaccttaacgtgctcagatactgcttttgatgcgtcaaaaaagcttagacactgcaacgcgctaaccccacccgttgatacctaagcttcttaaactaactattaaataatcaccaatccgtcggcaaagaaccctcgacagcattggtcattatttcaaatacttatctttttacctttacccttgaatattctcccaaggacttggaaaaatgtcagtgattttacaattcgatcaggctcaatatattgcccgaacggctcgtaacactttcttagggtccttagctgagaaagtaatcataccgttccgtttcgtttgaaaagagaaccgcggaatccaacggccaccaaacattacggatacgaccacatatttcacttcagtccaagggatttgaataaaattacgaacattgcgatcatcataaaattcaaagccgttatcaccgaccataattttaccgtaatcggtcaatcccatatgtgaattaccgttcgtaactaaatcaaccttagtattgattgattgcaccatattaatccctcctcgtatccatcctcataccgattatacggcgagtttgtcagttatgcaaagtacgcttgtaaataaaaaggatgagctcccacgagtccatcctttaaatatgacataagcaagtattacatccaaccaataacgtgcattagaaccccaaatacgaagaggccaagaatgataatgattggtgaaactttcttctttaataacacctcacatgcagaggaaggttaacagcaacgccatcaaaccaggaatcaattgattcaagttatcttgtaaggtggttaccttgtatttgtcaagtgaacggccagcagcttgttgtgttaaagcttccttaacaccagaagcaccctttggcagtttatcccagtcaatgtacgaaccagcttgttgcttaatggtcgaaactttaactggactgaagtcaacaacaacccaccgttcgattaacgccgccaagataaacatccctagcatggaagcaccacgggtaatatcttgtaaaataccaccagataagtcatcagtaatcttagaaccggctttgtaaccgaattcttgggtataccacatgaagcccatccgaatggcattccaaacaacgaagtacaagattggtccaacaatgctaccagaaatagccaatgatgcagctaaggcaccaacgataggcttaaccgtgtaccagaacactgggtccccaacacaccggctaaaggtcccatcataccaactttaaccccttgaatcgtaacgtcatcaataggtgccccattggcacgttcttcttcaagcgctaaggtaacaccaataactggtgaagccacgtatggatgggtattgaagaattccatgtgacgcttcaaagcagcagcacggtcttctttagttgtatataatttcttgattgctggaattaaagaataagcccaaccaccgttttgcatacgttcgtagttccatgaaccttggaggaacgttgaacgccaccaaacatgcagacgatcacttttacttaatgtaactttttagtaatatttgtagtttcagacatctcagtttgcctccttctctaatacttgtcgataatgtcgccaaccggatcacccgtgttggagccaccaccattgccagagttaccttgctttgaaagtgccaagtacattaaggctaaggaaataccaattgcacctaaaccaatcaaagtaaatttcactgatcgcagctaaaacaaaacctaaagcgaagaatggccaaacttcacgagaagccatcatgttgataaccattgcataaccaacggcaacaaccataccaccaccgattgataaaccatcagttaaccagctaggcatagcgtttaacattgccttcactggcgtagcaccaacggccaaaatcaaagcggctggaatcgcaatacgaagtccttgcatgcagatcgcaacccattgccagaagtcaattttactaaaactaccttcttcagcggcacggtccatgatgtggacaatcccagttgctaacgtacgagcgatgatcgttaagagtaacccagcaacggctaaaggaacggcaatcgcaatagctgaagtaactccggcacggccttgaccacctaaaactaaaataattgcagatgcaattgatgctaacgcagcatcaggtgcaacggcggcaccaatgttggcccaacctaaggcaatctatttgtaaactcccacctaagataatacatgggactaattgtccggttactaatccgattagggtacatgcaacaactggttgatggaagtggaattcatccaaaataccttccataccagctaaaaatgatacaagtacgactaaaatcacttgaattacgttcaaattcatgatttaatcctccatcttttctgatattcttggaactacttttgttccttcaacatattttcagctttgttcaaaatgttatccatattttctttaccatcacttggaaccttccgaacatcaaattcgatgccgtctttttcaagtttacggtaagtgtcgatatcatcttgatcaaatgccaaaaccttgtttggttgaactttaccagccgaatgagccatcgaaccaatattcaatgtcttaattggcacaccaccctcgattgcacgtaatgcatcttgtggtgtttcgaataagaccaacgccttttgaccaccaaagtgctcttgtcatctttagcaatcttaatcatttgagcaattggaataacgtgcgctttgacaccagatggcgctgcttgcttgatcatgttagtccgcagttcgtctttagcaacgttatcagacgcaacaatgatccgagttgggttaactgtcttactccaagcagtagcaacttgtccatgcaagagtcgcgagtcaatccgtgctaacccatattccaacttccctggccggccagcattattgttggtcgttgcagcggcagcagccttttcttccttaggtgctaatgcttcaggacgaacctttacgccatccttagcagtttcaatgatatgcgtggcaatttcgtgtgccgaatccattgaaagtcgtgaagcatacgcttcaattaacattggcaagttcaaaccggcaacgattgcccatttgtccttgtgtgcttcaaacaagccgttaacttgattgaatggtgtaccgccccaaaggtcgactaagaataagacttgctcttgatcgtcaaatgaagcaatggctttttccaacttagccttgatgtcgtcagggccttcgctaggcatcaacgtaacggcttgaacgttttcttgttcgccgaaaatcattgatccagattgatagatgcctttagcgaattcgccgtgactagcaatgataatgcttaccatctttgtacctcctatttttttcgttacagtcatataaaacgaataaataatatctaaattgcctgtaactatttatgtttttgatactgtaagcgcaatctttttcgcactcacttatatatatgcaaattccgtgccaaaatacactaaagctaaaagcccttatttcaggcccaaagttgatacactagtgtgatacagtattaaaaacgattattttgtgtgtcaaatagcgtatttttaatataaaattatgaaacagtaactaatgttaactatggtatcaatttcttaatagctcagtgcccgacgaccttaatttaattgccacatcgtctcaaacgcttggttatccatctgtccggattgaccacgccaaggatcattgtacctaatagttgccgttgtatatccagtgagcgtcactgtatgactcgcaaaaccatcgagtccctgaacccaagcgactaccggatgacgtttagtgagctgtgctttaagtcgttgcagacccaccccgctgagatctacagcggacggcagatagtggcggatcgttggtaacaagccttgggggtagatgtagagaccaataccgtaagccgaagcgggatcaccaacaaaaccagtgttaggattcgaactgcgtggcacgtggctggcaaactgttccttattaatattaacgccggcatactgcagcatcatggtagtcgctgtcatctcacaccccgttggcaactccggtagctggtcaatcagtggtacccgcagttgaaccgacgccgtactggcgggttttagctgattagcagctaatccagccgctctgctgatgaccattatgcacgtagtagaagcgctggtaatgcccgttgcgataaatatcagcttgctcagtacgcgtccactgtgtatgctggtgatactttaaatgtaaattaacacgcaattgggcacgctgatgacgcacgacggttaaatggtaaccgacaccgttctgactattcgtctgatagacccgcggctgcaccacctgaatccctgtaatcggataagtcgttacggccgcttgtgcggggtaaaccacgccactaacaagcactccgcccaccaagatacgccaccaccatctactcattctaatcaatgcctggtcctcgccttctcttaatatcgtaatcagtagattaaccgttttcattataatgctggtaatcatgagattaaacaataaggtacggcaaatttggtgaacatagttgaagtagttggcaaaaaagcaagcctgaaataacatgaccagtccaatttacccgcaaaaaacatcgatccatcaagctgaccctaatcatcatattgacaatgaagaagctaagtacattagcagttaccttgatgatagaatttaaaaatgacactgaactatatggtgcctaccacgagttgtcttgaaacaggtcgaggtcatagatgagtaaaggttcatcagaattttataagatcatgtatcacgttcacggttactatttaaatagatggagtaaatacttattagcgacaaacgtaaactggtttggtgacaacatgttgaaaaaggtacagaacataaagaagtcggcattaagaaaaaaattataggtaaaaaaaagcagcgctgtccccgacataactgggacttaggctgctttttaatgatagttccgtaaatggtaaaacctacgagatagcgtatgaaattactttggtagcagagttccattcaattatcagtcctttaccagcttgggtcaccgctgtacaagcggatgaacacactaacacctcagtggaggatgcgaaagcaaatacacctgaaatcacaactgtgttactgcgtgttggtactgccgcagttgtggctctcgcaataactagtttaataatgacagctacatttttaccgtcgattatccccggattaattaccttagctgctgcgtaataatgtaaaatgctatatggttagacaaaacgattggagtcatccgatcgtttttatataaaaattaggagtggtaaataatatggacacaacacaatttttatttttgtatggattatgtttttggcaattttcattctgagcttgctctttgcactctttacaccaaaggcattcacttacacatcacaaaatccaaaatctaaacaactaatccgtaagatactgataactaaaccaattagagaatatcggcgacagttaaaaataagtatcctctttagtacgctgggactaatagtaatgtggattggaattattttatttgcgttcaagtttgtgattgtctcacttttttacttgccattgcatcagcatcatatatttttatcgaggttgtcactccttactatgaatataagtactggtcaagagcaaaaaaaaagaatttgggacgctgccacataaatcctttataaaattaatgacatgtcgaacaatatgtacgataactttgactcttttatttttactaccagcaattttcaactctgaattttatgatatcttatttaacatttttcttaaatcaaactattccggagccgaacaaatgcacaattaaggtcgattctatgtttgaacatgaatcaacaaatggtaaaacctacgagatagcgtatgaagttactttggtagcagagttccattcaattcctttaccagcttgggtcaccgcagtaccagcggatgcctttttgactatgctgctaattgataaacgccgcgggttacatgatcaaaataatctgattgttgcaaagtcttggcgaatcttagcttgccaattacgattattgttagccttacgacaaccatcgagtagttgataaatagcgtttaaatctgtagctccgcctagagtttcaagcgctacttttacgaggcgcgcccaggtcacacggaaaagttgacagagaatcaataaaaaagccgatatatcaacgatttctcgtatcaatatcggctattctgtatataaaatgcggccaagaagattcgaacttccaccgggttaaccccgacaagatccttaatcttgcgcgtctgccaattccgccatggccgcatcacaactcacaaaaatatcataacaaaattttgcgagtctgacaagcttattttaagatttttgtacttttacaccagttgcatccattggcaataagaataattggccggtgagtgttgtatcttggctcaattgtgcccgcaacgtagcgagttgaccgtaatcacccaaagtaatcaccgtcggcccagcacccactcaaataagtccccgttaatcccagagcgtgggcatggtccctaaccgtttgtagtgccggcactaacttagcccgatactgttcatggaactggtcctgttctagcagcggtaacgccacgtcccaattttgagttgctagagcagccactaacgtattcgccacactactaccagtaacggcttggtggtacgccaattcagttggcaagacttggcgactggcggtcgtcaatagcggttcgttaggcacgtagacacttgcaaaaagcatcggtaacggtaacttcaccgcacggacgcgttcatcagtgttcgtcgccacaaccaagcctcctaatagggctggtgcaacgttatctggatgaccctccagttgagtggcaacttccagtagctcagcagaagagtgcgttgcgccggtcaattcatttgccagcactaagccggctacgatggccgtcgagctactacccaatccgcgcgctaacgggagtttttttgaagccatctgtaaatgctgtggttgtaaatctggtaccaaatgcaacgccgttttaataattaagttgcgttcatccgtcggcacatccgccccaaagggatggtcaatctgccaatgatcactaggttgcaacacttgtagcgttagttgcatgtccagcgccagaccgattgaatcaaaaccgggaccaagattagcggaagtcgccggaaccgaaatcgttaacatgtcctcacctacgcattctttaaaactttataactcgctaatagttgcatattctcttgttcaccgatttcacgagtgatatctgctaactgttgatcattcatggcatgggtaatgatcacaacacgagcgttgccgtcacctaattgattttgaatgattcgactaaatgaaacttctgcgcgggtcataatcgccgtcaatttcatcatcatccccggcacatcacgcatcttcaaggcaataaagtgaggatacacaacatcttcaggcgttgctaagactgtctcctggcgataagagttaaacgtgttaccagtcgtattcaacgcaatatttttcgcaaccgttgtaatatcactcagcacactgttggcggtcgggagttctccagcgccgggaccgtaaaacatcgtgttccccacagccgttcccgttaccattacagcattattttcattttgtaccgtggcaagtggatgctgatcagaaacaagcacaggcccgactgagaccgcaatgcgatcgtcaatttcttccgcaattccgagtaatttaattgtatacccaagctggtgagcttccgcaatatcctctgggctgattttcgtaattccctgaacttgaacgtggtcgagggaaagactcatcccaaaggcaaactgcgttaaaataatcatcttgaacgccgcatcaaggccttcgacatcattagtgggatcactttcggcaaaccccaagtcttgtgctgagctcaaggcttgatcatacgaccaatgcttagtcagcatctgcgtcatgatgtaattagtggtcccgttgacgattcccatgacccgttgaatccggtcagcggcgaaactattatcaatcgtccgtaaaattggaatcccaccagcaacactagcttcatagaataagtcgcgatgattttcacgagcaatctgaaccaactcccggccatattgcgcaatcaagtccttattggccgtcaccacgtgtttgccagcttgcaaggcttgcgtaatatattccttcgccggatgaattgaacccatcacttcaaccataatttgaatggacggatcatcaagcggggtcgcgatttggtcggtcatctgaacgtcccccaaatcaacttgttcgtgctttttcaagttgtggacaactacgcgaggctagttccaacttacgaccggtaatttctgaaatcttttcctgatgcgcttgaagcatttttacaacgccggtcccgactgtgccctaaactagtccgaccacaccaattttaatcgtttccatcttaatccctccatatcaatagttaagctaattctatcggaagcgtaccactttagcaaaccttttcagactaatttaattggcccctgacaacgaccacacgtatagcggcgagtgtccatgcggcgccgcggtaataccgctggccacaccgttggcattcataaatataccgatacggccgggccgtcgcccgcttcggcgctggtgcataacgcgagccacccacttgcgcgagtaatcgtttaaagtctgcatcacgatgccgatatccccgcttagtcaaatgtaaatgataatggcacaattcatgcttgatgacgccaatcaaggtggcctcatcaaaatcagtcagcatcttcggattgatatcaatatcatgcgaggccaactgataacgaccacccgtcgttcgtaaccgagcattaaaataagcgcggtgctggaacggacggtgaaaatcacgcatggaaatggtcgcaacgagctgctgtaactctaaatcagtcattatgcttcagccggtgcaatcatcgtcaaagcaatgcgctgccgctgttcatcaacttcttcgacccacaccgttacgatgtcgccaactgccaccgcctgacgcggatctttcaagaacttatccgttagtttggagacatgtacgaggccatcttgcttgacaccaatatccacaaacgccccaaagtcgaccacgttgcgtacggttccttgcaactgcatccctggttttagatcactcatctttaaaacgtcttgccggagtaacggtgcgggcatcgtatcacgaaatcatcacgcccgggcttttgcaaactactaataatatcctttaaggtcagttcaccgacaccggtgctggtcgcaagttgcgctaaatctaattgattcaactgttgggctttagtcgtcccaacgtccgtcgtcttcaatccagccgctgccaataacgctttggctgcgggataactttctggatgaatatccgtgttatcaaaaacattcttgccgtcaatgattcgcgggaagccgaccgcttgttcataagctttcggtcccaaccgcggcactttttcaattgtggtcggctcgtgaattcgccattttcatcccgataagtaatcacattttgggcaatcgtgctggatagccccgaaatatgcgtcaatagctccgaactagcggtattcaaattgaccccaacttggttaaccgcggtctcaatcaccgtatctagctgcgttgtcaattccttctggggcacatcgtgttggtattgccccactcccactgacttcggatcgattttgatcaattctgccagtgggtcttgtagtcgccggccgatactgatcgcactacgttgttcaacgtgtagctcaggaaattcggcgcgcgccttagcactagcagagtacacggaagccccggcttcgttcacgatgacataattaaaccggtcgggtcatagtcttcaatacctgtgccacaaactcctcggattcgcgggaagccgtcccgttaccaatcgcaatcatttcaacatgatacttctccaaaaaggctttaaactcacccgcagcagcttcccgtttggcagttggggctggtttgtgtggataaatcacgagcttatctaagaacttaccattcgcgtccatcacggctaatttacaccccgtccggtaagcggggtcgaaccctaataccacgcgaccttttaatggtgcctgcattaataagtggtgcaaattatcgccaaagactttgatggcctgttcattggcagccgcactcaattcgttgcgaagttcacgttcgatggccgggccaataaagcgtttgtaggcatcctgataagcagcttctactagttcaatcgctgggccgtggtgctgaccaataaagcgaaaatgacaataccggtcaattccagcacgatcaacatcaatgctgactttcaatactttttcggcttccccacggttgatagccagtacccggtacggtaccatctgcttgatgggactattaaaatcataatactgttggtaaacaccttgttcatcggctgctttacccttgggtttcacttttgcgactagtaagccccggtcacgcgtataattccggacccagtttcgtaaaccggcattatcaccaaaggcctcagctaagatttcgtgagctccagctaacgcggtattcgcgtctgtaatgtcctcgcgcttcgttcacaaactgcgccgcgtgttcatgaataccacttgccggaaaacgtaataaccaagctgctaacggctccagtccagcatctttcgcaatcgttgccttcgtacgtcgcttctgtttgtacggtaagtacaaatcttcgacatcttgcaacttgtcagctttttcaatggcttgctttaaagccggcgtcaagtgatcttgttcagcgatcaactttcatcacatctgccttacgactctctagactcgcaagccgatcatagttatctttaatttcgcgaatttcaacttcatctaagttaccggtacgttcctttcgataccgtgcgataaacggaacggtgttgccttcgtccatgagtccgagaaccgctttgatctgttgcggtttaaacttcgtcagcgtttgattaactaacgttaaaatctgattatccattatttcacccaatcttttaatctcattacattatattatacgcgttttacccaagtttccgcgccgaatgaccatctgaaaattgtcgttgactgtcactaccaatcgaagccattaccgatactgttcacacattggttgtgagctggaaaaaaccagcccattaggctaaacgaacacggcgcggccgcacagttggctgccccgcaaccaacaataaaacgctcggcaacgcataaacgttaccgagcgttttattagtgtgctaaatccaatcacccacccagcttagcgctcctacatgactgtattcatgatccgttgcacgttatttgaaacgcggcccatttcagtctcttgatccgtttcagcctgattaaaagcagccacatcaatcgtttgatcgtcgatgttcatgctagccgtcatggccgcacacgcattcgtgtaggcttcgtatgctgctaacaaattacggtgccgccccattaaccgtgcgggtaccgcaacttttttcaactgtgccaaattttgttgatactgttcagtaccatcgctaaattccatctgaatatcattgaattcagctggaaccattttggcaactgcgtcattatcaatggcctgacgtagtttttcaaaagatgggtttaattcttcccccattttttcagtactttcgataactttagacagtactggcatatacgtttgaatcgttgcttttttcatgtacaaactcttttctttaaattagttagccttattttacccctaaatgggtgggttatgcgcgccgcatgtgtcgacgttggaagaacttaacaatttcaacaatcacgaccatcgataaggaagctaaggccacgattccccattggtaagcatccaagtgactcacgtggaataacccattcagaccgggaacgacgattgtcatcgccagcatcacaaatgcaattagaatcgcccaattaaagaacttgtttcggaacaagccgaccgtaaacaacgattcatgaatggatttggaattaaacgcgtggaacagctgaatcaagccaagggtcgcgaaagccatcgttaacgcatcagcatgcgctaatgaggccgttgcgtgaaccggatacgtcaaagctaaccagtacacgagcaacgtaatgccaccttccagtagcccttgataaataatactgctgaagaccccacctgagaagaaattagaatttctcccgcgcggtttatgctgcataatgttcttttcagttggttcaacgcctaaggcaattgctggcaaggtgtcggtcactaggttgatccataagatatgcactggtgctaagatttgccagcccaacatcgtcatcacgaacagggttaagacttcccctaagttcgctgacaaaaggtactgaatcgccttttgaatattggcgaacacttttcggccttcctcgacagcaaccacgatcgtggcgaagttatcatcagccaagaccatgtcactagcccccttggaaacttccgtcccagtgattcccataccaataccgatatcagcagccttcaaggcgggcgcatcgttgaccccatcaccagtcatagcaacaactttgcctcgtttttgccatgcgttcacgattcgaactttgtgttcaggcgccacccgggcatacaccgagtaatcgccgacctttttgccgaattccgcatcactcattgcatctaactcggcaccagtaatcacagcgtcatcttcgccagcgttaatgataccaagacggacggcaattgcttcggcggtatcacggtggtcacccgtgatcatcaacggccgaattccagctgatttagcttctgcaacggcttgttcaacttctggccgttctggatcaatcatgccgaccatcccggcaaagaccaggtcattttctaacgtctccgtattaacagtcgtcggaaccgtggtgatcactttataagcaaatgctaagacccgtaaggcttgcgttgccaattcatgattaacagttagaatctggtcacggcttgtcttggttaacggctgaacgtcaccgttactttcaatctgagtgacccgtttgagtaattcatcaggagcccccttgacggctactaagaagcgaccatcttctaaggggtgcaccgtcgacatcaatttacgttccgaatcaaaggggacttctgttactcgggggcggtccgtcaataactgatcgactggataaccctgatccaaattatattgaatcaacgctgtttccgttgggtcaccgctaacccatccggcatgatcttcgtatcattacttaaaatcatcacttgcgctaaatggctatcaagcggcaattcagtagcgcgcgcgtccaccagttcctggttgacgaccaacttttcaacggtcattttgttttgcgtcaacgttccggtcttatcagaggcaataatatcggtacttcccaacgtttcaactgcgggtaattttcgtactaacgcatgccgtttggccatccgctgggttcctaacgctaacgtgatcgtaacgattgccggcaacccttctggaattgcggctacggctaacgaaatcgccgtcaataacatgttgatcaaactctcttgaccacgcagcattccgataccaaataccactgcggcaataactaagattaaaatcgtcagcgacttacctaactgtgtcaagttcgcttgcagtggtgtggtcgtctcatcggccgcttcaatcatgccggcaaattcgacctacttcggtctgcatcccagtcgccaccacaatcccagtggcccgaccatacgtcacgttactattcatgtacgccatgtttaaccggtccccgattggtaattccccatcggcaatcatctccgcctcgcttctcaactgggacagattcacccgtcagcgccgattcttcaaccttcaatgacgcactctcaattaatcgtaaatccgcgggaacgatatccccggcttctagcgacacaacatccccaggaaccaacgcgtcactcttgaccgtttgcagctgaccatcccgtaaaacagtcgcgtccggcgctgacatttccttcaacgcgttgatggcctcttccgctttcgattcctggaagacaccgaaaatcgcatttaataccaccaccaataagatgataacggcatcgacggcttccccagtaaaggcggcaatcaaggcggccactaacaggacgataatcatgaaatccttgaactgcgcaataaatttttgcaacaaggaagtcgtttttgctgattcaacgcattcggcccatattgttctaaccgttgcgacgcagcactttgctgtaagccgtgttcatcagtgcctagttcctcataaacggcggataacgcttgttgatactttggttttgtactcatcgtaagctccttttctggcatccgagccccactccctaactgatctccagatagaaaatgagactcatgtatgcacgcaaaattgtgtgaacatacataagtctcactatttaagacaataccggattggcttcttgctgacgatattgccgcagaatatttctgctagttactcccttatgattgtatcgtaagaataccagattccatgggagctgtctagcaaaataatcgctttgactacctctgcattcgccacagcacttggatattctcacattaagcgtttacatattttaaaccattctaccgcttttccaccaatcccaccaaactattacggtagtcaccataaaattatgtgactatgcaaaaaggcgacctgaagctgaataatcttcaagtcgcctttttaatcaggttagccgtaatcctaatcgattatcagctaactagcttatttccaaaaatcatcaaacacagtgatggccgcgtggcgtttgtgggcagtctttaagtaccacgcctcaatcttttcggccgcagcatcgctgaccgtccggccttccaagtaatcgtcgatgtcgtcgtaacgaacacctaacgcgacttcatcaggtaatgctggccgatcttcttccaagtcagcggtcgggactttgtcatacaaatgcttgggcgcatccaaagcggccagcatctgtttaccttgacgtttgttcaatcgccatagtggcacaatatccgcaccaccgtcaccgtacttggtataaaaaccagtaacagcttcggctgcatggtcggttcccacgacagcgccgtgcatttcaccagcaatcccatattgcacgatcatgcgttggcgcgctttaatattgcccttgttgaaatcatgaatcgtcaattggttagcttccaatgcagttaccatggcatccgtagccggttgaatatccacccgatccgtcacgtcggcttgcataaaatcaatcgctgccatcgcatccgcttcatccgcttgattgccatatggtaaccggactgcgatgaattgatagcgatcatcacccgtttctgccgcatttcggtaatggccatctccgtcaattttccagctaacgtggaatcttgaccgccagagatgccaagcacataggtcttcaaaaaggtatttttagttaaataagccttcaaaaaatcaatacttcgacgaatctcaacttctggatcaatcgttggtgcaacgtgtaacgctttaataatctcagcttgtaatggccgcattagtaagcttcctcctcatctttatggttaacgtggtctctgaccgtgtttaaaataatattcattttatgatcataaagtttttgtgacaagtcgaccgggtaatcctgagggtttaaatcccgcttgtattcgtcccagagtgcatctagactttcaaatgaatactccttgatttcatctaacgttggtaaagtataaacttgttgaccgcggtcatagatgggaaccaatagtggtcgcgcatcaaaatcgctgaccgtcttattaatatacgtatagcttggatggaacatgtaaattgattcttcgttgcgcggatcttcatcgtacaacgtcacatagtcaccttctgacttgccatccgcacgcttcgtaatccgccaaacttgtttttgaccaggcgttgagaccttttccgcgttatttgaaagtttgatcgtatcaaccatctgatgatgatcattctcgatcgaaaccatcttgtacacggcccctaacgcgggttggtcaaaggccgtgattagcttcgtcccaacaccccagacactaattttagcaccttgcatcttcaagttttggatcgttttttcgtccaaatcatttgacgcataaatcttggcatccggaaaaccagcttcgtctagctgttcacgcacgcgttttgataagtaagccatatcgccactatcgatacgaaccccttggaaattgattttatcacccatttccttagccactcgaatcgcactcggcaccccgctacgtaacgtatcatacgtatccactagaaagacacagtcatgatgggtctccgcataggccttgaaagcttgataatcgtttcgataagtctgcacgagcgcatgcgcatgggtcccgctaatcggaataccaaaaattttgccagcccgcacgttactcgtcgcgtcaaagccaccaatataagccgcccgggttccccagatggccgcatcaaactcttgcgcccgccgagtaccgaattctagcaagccatcttcaccgacaaccgacttaatgcgcgccgctttatgtcgcaatcagcgtttgataattgataatattgagtagtgccgtttcaattaactgacaagtggccagtggtccttcgacttgtaacaacggttcattattaaagaccaagtctccttcacgaaccgcacgaatcgtcgcatcaaatttgaaattcgctaaataatctagaaaaccgtctgagtagccacccagttcacgtaaatatgcgatgtcagttgccgtaaaatgtaaatgattgatataattaacaactcgttccagacccgcaaataccgcgtacccattttggaacggcatcttacgaaagaacacttcaaacaccgcatgtttgttgtgaataccttgttcccagtaggtttggatcatattaatttgataagcatccgtatgcaaggtaaaactatcatccggatagatttgcgtcatgagtataattctccatttcgtaggtaataaccgtgtttacagtaagttaagcttattttagcatttttatataaaagaatgcgcttaagcatccaaaaagttgcagaattcgttgatttacctatactttaattatgattagaaagtgaggtcgcttatgtcaatcccttttgacacggttaacatcttaaacgtgccgtttatcaagacaactaacgctggttttgttcagcaacttcaaaccgatattctcgcgcatcgcaatcgctttgtggtgaccgctaaccccgagatcttaatgtacgctcgtgaacaccccgattaccaacaggtgttaacacaagcggactatatcacgccagacggcattggcgtcattcagggggcccagattcttggcacaccactccccgaacggatcaccggctatgacacccttttaacactactagaatggggtagccaacagcaccaacggatctttttgttaggtgccaagccggccgtgttaaagcaagtgaccacgatcgttcaacgagattatcccggcatcgttgtcgcgggtgcccgtgatggctattatgacgacgaacaaatcattgtcgaccaaatcgtggccgcgcaacccgatatggtcttcgtagccactggttttcctaagcgggaatttttcatcgctgaacaccgccaacgcctcgatgcgctctggatgggtgtcggggtagcttcgacgtaattgcgggcgcggttaagcgggcgccgttattttggcaaaaacaccacgttgaatggctctaccgtctgattcaagaacctagtcgtttcaagcggatgctcgtgttaccccgctacttgcggttagttaaaaaaatagcgcgccagcaagcccattaactggcaatcattaccagttataagccactgcgttacgatgacaattgcttttgtgcgtgtacccagtcttcagtcatgaattcaaaaatagctcacctagaataacatcctaggtgagctatttttggtatcaccactctaatcaggtgcccagcacccgaccgactggttatttttcaagaaagataaaactcaaaccggttaccaacgtactgggtccgcacgtattcaaacggttcgccggtttgcaaatacgaaatctgccgtaaccgtagcaacgcatcgccacgccggactgacaagtattccgcgatacgctcagaagcagacatcgccgaaaccgtctgttgagccttaccaggcactaaacttgccttctcttccaacgtccgatacaacgaactcgtaatttcgtccttggtgaactgcttgacgagtcgttctggaactgttgcgacctcaaaacaaattggcacatcatcaccatagcgaattcgttccatccgtagaacttgttcgttggcgcctaacgccaacttttcgctctcagatagcgacgggctcgtcacgtgatatgaaatcgtcttacttgatgggaccttaccctgggccagcattagatcagtaaaactggtgacaccggacatttttcttggaccttctgattcgcgacaaacgtgccggcaccgactcgccgctctaatattccttcgtcaaccaatgtctggattgcttgtcgaagggtcatccgactaacatcgaactgtgtagccagctcccgctcagacggaatccggtcaccaacggcccaccgacccgcttcaatcgcccgcttaatttggttgtggatttgaatataaattggcgaactcatggtactcatcccttacttctaatttatttagctgctttttaccgtagctatatgttgcgactaaatcttgattgccatctaagatgttgatatcagcatctttaccggcttccaatgttcctttcttagtcaacccaaattcacgtgcttggttgacagaagccatcttaaccgcttcagcaatgccgcaaccggtgaacttctgaatattcttgaaggcattaatgaatgtcaggacagaaccagccaagttaccttcttcaagacgtgcttgaccatccttaacaatcactttttgaccacctaattcactgataccgtcgggttcacccttggcacgcattgaatcagtcaccaattcgatccggtcaacgcccttttgttcgtaagcgagcttgatcatgtcaggcacgatatggaacccatcacagatcaattcacagtacatgttgttttcaagcatggcatgaccagtaacacctggttcacggtgcttgaattcacgttgcgcgttgtataaatgcgtcacgtgagttgctttacttgctaataattgttcacgagtcgcgttactgtggcccactgaaggcacaatgccattttccaagcagtacttttcaaattcacgcgaaccaggatcttccggcgcgtaagtaatcaacttaacccgaccacccgacaacttgttccagttgtctaataagtcaacgttaggattcttaatgtacttttcaggttgggcacccttaaacgtcgccgaaatgaatgggccttccaaatgaaccccttggataaccggattttcaatcggcggccttgttaataccggccatcgaatggtctaagttttcgttggattgcgtcatggtcgtacagaagtatgacgtaataccttcgcgggcaaccatatcattaaccatttcgttaatttcagctggattcccgtccattgaatcaaaactataaccaccatggctatgaacatcaatgaagcccggtacaatcgttttgccactcacaaattcgatatcatcatcgggttgggccacgtagtcatccattggaccaaccgcttcaatttccttaccgaaacgaatgtagccgtcatcgatcttttctagaccagtataaatgatggcatgttttaacactttgctcatgaacaattcctccttggatttatctggtttaattataatcggtatagaccaaacttgcaaccaccagcaccaagtaatttaagattcgccaagttccttcgcaatcgttgcatcaattcccttcaccactgcggtcataaagccgggcctcttccatggccagtaatccagcaaccgtcgtgccaccaggtgaagaaacttgatcgatcaggtcaaacggaattttatcagaagctaaaacattctgcgcactgcccagcgtggctcgcgccgcaatcttagtcgctgcatccttgctcaaaccgtgcttgacgcctgcgcgggccatcgcgtcaataaagaaatagatgtaggccggcgaactacccgctaaggctgaaaaagttggaaaatctttctcagcgatggcactcgtggcaccaatcgcatcgaataattgttgtccagccgcatattgctctggtgttaaggcatcattaccaaccaacgccgtcatcccggcaccaatcgccacgttcacattcggcatgattctcagaacggggagatcagggacaaccgtggcataatcggccaaactcaatcctgataccattgtaataacccacttgcccgttaaggctgcttgaacttcttttaatgcagaccaacgcaatgttcggcttaactgccaaaacgataacgtcagcagcttgtgccacggccaaattagtgtcacaggcctgtagcccatttttttgcgcataaggttgataactcgcagcatgggcactgtgaatataaatatctgctgggacgaccgcttgttgttttaaccacccatcaataatcgcgcggcccatgttaccggcaccaatgaatccgattttcatccgtaaaacgctcctctgacttataatttatatcattaaccactaaccgattaacggctaggcaggattaaacagacattcccgcttactcttctactataccaatatttgtgaaactgtgggtaattaatcacttctttcagctcaactttcactactatcaacaaataaatatcacgagccactctattaaggtgattgcttatcaatactgaaaccaattgattaatctattaataatcggccttcaatatgtgcgaagctcgttgacaggtctgcttgaacaagctaatgtaaacagcaatcaaacacagcgttgcttccgaacacggctgtctaaaaacaactaaggagtgtttcactatgaaccagaacaaccatttccgactcaccttatcaaccctgctgcaacaatgccagcaagacatcactagtctgcccacggccatgcgcgccgtcttcagctggcaacggggacttaatgaattaaagacgcttcgccgcaccactaagttgatgatgagcacgatgctaatcgtaaccatcattggttttattctgggtcgcgattacagcctacatggctggattggcctattgaccgggattacggtcgtaattaacttaattctggttgatcaagggcgactgacgaactatagttggggcattattgcctgtgcggcttggcttactacggccatcaccaatcggctgattggtgacattgcgtcgcaatcattttaccttatcatgcaatttgtcggcatcaccgtcttctctggcatcgtaaaatggcagcgcaacccgatgccagcgaactgactggtcgtaaattgagcaaattagccggttgtgcctggttcgcgttagccgtactcgtctacgccattgtcttacactttagtaaacagcttaacggtaaccaaatctacctggacgcgaccctgttaccacttgggattgtcggtagtgtcctcatggtcaacggttatcgttcccaatgggttgcatggatcacactcgacgtgattaacgttattatctggttcaaccaattaaaaggcttcagtcccgcagccgcctcaatgttagcattgcaactagtgatgctcgctaacgcgttatatggtgcctacttgtggttcttcggtcaaaacactcagcaagataaactagatacacattaagcaagctaactggcaatcaaaaccaagcactaatcgcttcaaagttaaacacataactttgaagcgattttttatttgggttaccgttcggaagtggctacatccttatctgaaaaatgtctatcagtttacatttagcgacgagtttgtttaagttagaactaattaactgactattgaggggacgtttaccatggtgacagtcgttcgtcgcacacttcacgataaaatctttattattgcattaatttgtgctggtttaagtttgttcatcgggacaccccaactgacggcaattaattgggctacgattggcaccttatttgcactcatgatcagtgttcaattacttcgcgcgatgcatttgcttgatactttaagggactggctcttagttaaatcacacgatacccgtcaaatgtgtcaattattcatcttactggcctttggtggctcaatgattttaactaacgacgttgcgatcctaacgttaattccaatctttctcacactcgcccggcggcagcacctggccattgcctacccaacgactttaattatcatggcagccaatcttggtagcgcgtttacgcccattggcaatccccaaaatttatttttggtcacgttctatcacgttaatctattcacgtttttaaattgtcgactccgttaatgcttgctagtctagctttattagttgccttaagctggcggttacctcggttgccgctaactgtaacaccaaccaaatctacgcccatttctcgcagtcaaatcgggcttgcgggcggctttgctcagtttcattatgcttggcatttttaatttggtgcccatttcactagttattatcggaacgattgtcgtaggcctcatgattaaccgacgcgtctttcagtacgtcgattacgcactactcttaacctttatctgcttcttcatcttcgttagcgccatcagtcataatcccgcaataacgcattggctcaaccaattgactcagacagcccccagtgtctatattactggactaattactagccaagtcatcagcaatgttccagccgccatcttactagcgaatttccaacgccccatttatcagcgctatttttaggcgtcaatatcggcggtctggggtcattggtggcctcactagcaaatctgcttgccttaaaacaattgttgcccttcaatgatgaacaaccactccaccattttttgatcgtgtttacggccctcaatggacttggcctgttcattttaggccttggtggctggttctatttacacctataattcagttacgctgagtaacgattcagtgagaacttgcaaaccaatcaacttgaaatagtgcgaaaaccagtaactagcgtgacatcataaaaggagcagtctcaatatcatgtgagcctgctccttttacgttctatctctgagatgtttagtgatacttagtgcgcctgatccaccaacatggccggagtgacgatttgctgaccatcgtagcggtgacccttgatcacgcgtttcgccctgacaaattcaccatcgaccgtcagcgttaacgcacaaattccaccatcaaaaacaggcctgaacgactgcccgcatcaattagatatcgtggaacgtcttgcgcatctgccgcatctttaaataaccagtgtgtgaaccagtcaaggtctgcaccggcgtatgaccagtaatgatgactttattgaataagttccgatgccaacggtgactgccagtcgtgaagtcatcataatagtcatcccgaatccacagtaggtcagtcgttgtttgttgtgttaatgggtattgccagttaacacccgcgtgcatagccagtaaccgaccatgttgccacatcagcggcaaatgtgctaagaaattagtatccggctttaatagcgcaccatttaatgcccgccgaacatgattgggattggaggagtaaatcctaatttgcgccaggtccggtgaccaccgttcaacacccaagttgcggtggcattgtcatcaccatgagctgtccgtagccaaaattcatcatgattgccaagtaaagccacatcgccgtatttcccgtacccgttttctaaccatcgtcagtacttttagcggcgccaacggagctgactcggtggcatgaccaaaatagcgtgccgccgtaccatcaatataatcgcccaagaaaatcaagcgcgtcgcggcaacttcaggattggctaataaaactgccagatcatccgcggcactatgaatatcaccaataaacgtatacagcggcatattactccctccgtctcatcgataaccacgtgcattagtcgggtttaacgaccaccaataacatctgaaatccttgaacggcatataacgcgtgccgggcatccttaggaatcacgatcgattgtcccgcagttaaatgataaatggtgccttcaatcgtaatttccgcttctccacttaaaatattgaccatcgcatcgccctgggcagaatggccgccaatctcttggtcggttgcgactgaaaatagcgtcatacttaaatcatcccgttgaaccagtgtccggctatttaacttgatcatcatccagtggaatttgttcagttaaatcgaggaccttagcatgatcaattttgttaattaaactcatttgaattcctccgcatctcgctattaaggcctatttcgtttctaattgaataaactggcacggctgctcagcgaccaacgtatggaccgtatgagctggcaccactaacatctcgcccgcatgcacttcttggtcggtctccgtcgccaaacggacggtcaaagtaccatcaacaacctcaaataagcgggtcagcgtggattgttcagcactaatactttcacccgccgccattgcgtacatcgcaaacggcagttcaatccctaattttcgagcaaatgatttactagtaattgcatgctcccggtaagtcatcgtggtttttaaatcaattttagttaccgccatttcaaatcctccttggtcatcatcatggtcgcttacgttattcatgatggtatgatttcttaaattaagcttaaaacgctaacaaactcaattttcgaggttcgattgaataaacatcttataattctgaataactgactgctagtcatatacttaataaccacgtcatctctggggtaaatgcctttgcatccagatatgggccatgcaaaaagctgcccaagcattattgcgacgctggacagcctgccgttactgcatttgataacagttctgtggaaaatttgatttattcagtcaactagttggggctggtagtgggacaaccaagggtacgcatacgcagcctcttcaaccaaatctcatagatcaagttccaatacgacttattttcgataataagccttggcccagcagttgcgacgctcccgacaccactgttcaaaagtacctacaaacatttggacatcttgcgcagaattagttcttccgttcgctgcatgtgcacaatatcagatatcaccggatcaaaagtatacgtaacaaccagatgttgtgggattcttcgaataaatcccaccgttgcgagtaatctctaatcgcatcgtctccagctcaagttgaacttgcgaataagtctctctggagcaataatcgacaacatcatactgctcataacatcgtttataccaggcatgcgaattagccggcaaatcatcaaattcaccacgattcatacgatttcgaacagcatggttagcgcgcttctttccataacccatatgtgctttaaaaattggtgtgcttttataagaacgactcataataattatgatggccgtcatgacgcgttaactagtacgtatttttaaaattaacaatgccagccattaacctcttccgtgtacttacggaataaataaattcattgaccagacctcctatcccatctggatcgtgccccaaatagaatactaaaacatatcacattattattgatgatggcaaataaacagaccgagacaaaaaaatccacttcatgaagaatctgttacgcattcttcacgaagtggcactacccgccgatattaagataaatttaagccaataaaaagtcgttacatcaagatcctaagacctgattaacgacgaaaggcgtaacaattgggctagctgggttcgaaccagcgcatcacgggatcaaaacccgttgccttaccacttggctatagcccaataatgaaatggaggggagtggattcgaaccaccgaacccgaaggagcggatttacagtccgccgcgtttagccagacttcgctacccctccgtaaatcattcaactatattagaatacataattttgaataaaaatcaagactttttcaaagttttttcagtttttatttcaaatccagaatttgcgtatcttgataccactccgccataaaattattggcttgccattcattgatacgcttgagtccatagcccactgcttggtcataataggtggtctgaccaaacacccgcggttgcggatggacgtgcaaatgaccaaataaaactgtgcgccacgttaaactgctccaacagttgtcctaaccggggcgttcccattaacgcgttagccatattccaaaaccgattatcatcagaaaagcgcaaataatcgatccggggaacaaagtgcgtcataaaaataacttgcttgtgatccacggcagccaagttaagctgcgcttttacttggttgagcattaaatcagtccgctcctgatcgctcatcggctgtttaatagcccggtcgatccaaaacgcattcttccagtgtaagaagtcggccgcagtcctatcagggacctgggcagcatactgatagtcataccacccattatgtccaatcacgcgccaatccgtaccagaaatatcgatataccggttatgcggtagccatcaaaatgccctgtttcaagctcgtcaaacgaaatgccatggaccatgtcatgattacccgcaatccagtaaacacgcgtctgtgcgcctaatagggcctgtaaatcgacgatcaaactgctgactacgctgaaagtcattaaaaagatcgccagcaatcaaataaatctgaacaccattctgtaaaagataggtcgcctgagatcgcatcatcgcagtcgcatccactcgattaacatcaaaatgattatcactactgaaagcaattcgtacgatggtcaacccctccaaaacaaaaagatatgctaccactaagataacatatcttcgagtaaatattcaatttagcgaatgccttgcatcgaccgtttaatcattggcaccatcataaagaggataatccctaaaacgacactaacaatcccggtaatcgcaaaatatggcacttcggtttgcgtcgagtagaaacggacaatctgtgcattaagtgcgctaccaaccgaatcagttaggaaccacatactcatcatctgagaagcaaaagcctttggtgcaagcttggtggtaactgataaaccaattggtgagatcaacatttcagcaatttcaacgacgacctctgcccaactggcaactaaccaccatggactaaccttccccgcagttccaaagagcgccccaggtacagccatcactaggtaagaagccccagcgaatagcaacccaatcgcaaatttagttggtgaactaggttgtttttaccccacttagtccacaaccacacgaatggtgttgtataaatcatgatgaacaatgggtttagcatttggaaatcagaagcagctagatgggtaaaaccaagatccaaattaacccggttagctgcaaataacgcaagtacggacgaaccctgttcttcaattgcccagaataaagcagcggcaataaacaatgggatataagcccgaacacgtgaacgttctgttgcattagtcttgtcagacgttaacatcaaaataaagtaaacgattggtgtcaagataacaagcgtactaattaaactaataacatttgctaacgtaagagcatccattaattgcattaatagtagaatcaaaccccaatcccaacgattcctaagattgtccaccgcatgattttttcaaatcaccgggttctaatggatcagttggatagaggctagcagaacttaaattcttcttaccatcaaagtagtattgcaatagaccaaagaacatcccaatcgcagctaaggagaagcctaagtggaagttaacatttaagccgatccgaccaactaaggctggtgcaaccaatgaacctaagttaatcccgaagacgaaaatactaaaaccagcatcccgacgtgtatcttccactgtatacaattgaccaaccatgtcagagacgtttggctttaataacccagtcccaatgacaataagtgcgattgaaacaaatagtgcaccaactccaaatggcgttgataaaacgatgtggcctaacatgatgaagaccccaccaataaagacggtcttacggctaccccagacacggtcacttagaaagccaccgaggacactagaaacgtaaaatcctaatgccgaatagattgacataatggatgctgcggtgacttggtcaaatccaagaccacctttagcgacactgtagtacatgtaatagatcagtagcgcacgcatcccgtagtaactgaatcgttcccacatttcagtgaagaacaacgtccgtaagccacggggttggccaaagaacgaccgatccagcttttgttccttatccaatagagattcctccaaacttcttaaccagtttgtatttcgtttaaaagtaacaagttttgtttcttaattaaacataataactattatactagccttaatcttaatcaacaatagcactaaccgttttctaatctaataaccattaattaaattaatatccaccatacataaatagtcttaaatccttttatagcacccaaaactagttgataggacattttataaggcttttagctttctaaaattaacactaaattctaatttaatataaaataattaatagcattcaataatgctgaaaatacgcaattggtattaaaaatctaattaaataaaaaaacaaaactgaaattatcaaaaataaagtaccgctattaaaatggctatgattgttcgtagcatgtaatttacagttattgcgactaattataataaaccgcaagattgatatgctaagcatacctaaaaagcagtggcgacaataggcatcatcctactaagcccttacgatcattttgatacttcggcattcaaatagctaacattcttatatcaaaaaagcagctttgcgtttgcgcaaagctgccaatcattttatgtctatttaaaaataaaaaggcgagaaccacgtcccacctcacaagtgccggctaccagagtcgaactgatgaccctcggtttacgataccgatgctctaccaactgagctaagccggcatgatataaaaatagatgttaacacaattgccaacatctatgtcactccgacaggcgggctcgaaccgtcgacatctcttgattaacagtcaagcgctctaccaactgagctatgtcggaataatcgcatggcaacgtcctaccctcgcgggagcgatcccccaactactctcggcgctaagaagcttaacttctgtgttcgacatgggaacaggtgtatccttctcgccatcgtcaccacactattgagaaacttgtgctctcaaaactagacaatatcaaatatcttcatatgaaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccagggtagcttttatccgttgagcgatggcccttccatacggtaccaccggatcactaagcccgactttcgtccccgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcgggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcgggtttgcggtacgggtagttaagtactcactagaagcttttctcggcagtgtgacatcagacgcttcgctactaaatttcgctccccatcacagcttgtccttaaagtgaaaagcatttgactcttcaccagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcaggactcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacacctcatcccagcaattttcaacttacacgggttcggtcctccagtgcgttttaccgcaccttcaacctggacatggataggtcacctggtttcgggtctataacctcgtactcaaaacgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcccgctgctaatgagatgtttcagttcacagcgtttacctccaactagactatgaattcatctagtggtaacagttgattaaaactgctgggttgccccattcggaaatctccggatcatagcttacgtacagctccccgaagcatatcggtgttagtccgtccttcatcggctcctagtgccaaggcattcaccatgcgcccttgttaacttaacctcatttacctaacggtaaatgcgattaatgagtttagcgataattaaacttcaataaaaactcaaaaaacgcggtgttctcggtttcattatgaaaaatatatttgatattatctagttttcaaagaacaagtttcaatgacgactaacgtcgtcaatggagaatagcgggatcgaaccgctgacccccgcttgcaaagcgggtgctctcccagctgagctaattccccatgaggtattcaacttatggaaccaactggttcggttccaatgggcctaaatggacttgaaccatcgacctcacgcttatcaggcgtgcgctctaaaccagctgaggctataggcccaaaaacgcttattaaattgagagttagacctctcaaaactaaacaaagtttcgaagaatgtgtaggtttccgtaatattccttagaaaggaggtgatccagccgcgaggttctcctacggctaccttgttacgacttcaccctaatcatctgtcccaccttaggcggctggttccaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaactttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccccgatgcacttcttcggttgagccgaaggctttcacatcagacttaaaaaccgcccgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaagctcggaccatgcggtccaagttgttatgcggtattagcatctgtttccaggtgttatatccccccgcttctgggcgggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtgctaaaatttatttgctagcgaattgacttcgcaaatgttttgctcttgattcaaaatcaagagaccctacacatttgattcgtcgaaactttgttcagttttcaaaggtctaaatcgttcgttgattacctcaacgcaacttaatcatcatatcaagttatcaacatcttgtcaacaactttttataattaattttcgttggaagcaagcgactaaccgctttgtgcgcctcaacaacgtatactaatttaccaattatcctgataaattgcaagccctaaaatgcaaaaataaccagtcaataattatcatgttaatcaatccactttgataatatacggtatttaaaaccataatcatgttaattgacttcaaatcctacctaccgccaccataaaattcgcttttacttaagtttaaccccaactgcctcaacaatgttcgggtaaaaataatctaactttttttcaataaatcgctttctgaactaaagttactcaatctgacccaacaaaaacggcagttagcttaggaaaccctaagctaactgccgttttaaatctaattatttatcttcttctggacgcatcgttgggaaaagtaagacatcacgaatcgaatccgcatccgtcattaacataaccaaccgatcaatcccgatacctaacccaccagtaggcggcatcccgtattccaacgcctcgacaaagtcttcatcaatatgttcagcttcgtcgttaccagcagtccgttccgcagcctgagcttcgaaacgttgccgttggtcaattggatcattcaattcaactgaacgcattggcgtattcattacctaagatgaagagttcaaaacgatcagtaaaccgtggatcttcttcattcttcttagctaatggtgaaatttcaactggatgaccataaacaaaggttggttcattcaacgtgtcttcaacaaattcttcaaagaacgcattaatgatgtgaccaactttccagtatggttcatacttcacgtgatgttcatccgccaatttttgtgcatcttcaattgacattggttgccagaaatcaatcccagtcttttctttaatcgcatcgaccatgtgaatttgcttaaatggttgattgaaatcaactttttgatcatgataagtgacaatgccatcgtcagttacggcttgcgctgcggctttaaaaataccttctgtctcagccattacatcatggaagtcgaaataagcgacataagtttccatcatggtaaattcaggattatgttcacggtccatcccttcattacggaaaactccaccccgaccaatctcataaaccttttccatgccaccaacgatcaggcgcttcaaatgtaattccaacgcaattcgtaagtagagatcaatgttcaacgcattgtggtgagtcacaaatggccgtgctgccgcaccaccagcttgattatgcaacattggcgtctcaacttctgtgaagccttgatcgtctaaatgatgccgaatcgctgaaatgatcttcgtccgcttcaagaaacgatcaaagctatcacggttagagatcaagtccaaataccgttggcgatagatctgttccacattctgtaacccatggaacttatctggcaatggtcgtaacgcctttgataagaacgttaaaccagttactttaatcgttaattcgccaaagtccgtcttaaaaacttggccggtaattccaaggaaatcaccaatatcagaacgcttgaagatatggtaagtattttcgccgactacatctttacgaatgtataactgcatcttacaccctgagcgatcccagatatcagcaaaaccgactttacccttaccacgcttagctagcatccgtccagcaatggttgccaccacttgtttagcgtctagctcgtccttatccatatccccatacttgtcttgcaagtcctgggctaaatcagtccgttcgaaccggtgaccaaagggatcaatcccctcttcacgcagttcatccatttttcgcgacgaaccttcagttggtcgttcatcgtctgttcttgtcgtgccactagtgttcctccatttctagttagcgtacagatttattccgtacctaaacaatcactacatgttaattttgacaatcacgccgccaaaatgcaagttaattattcactttaccgcgtgactagccaaataagttgccgtctgctcctgaaactgcgttaaaatgcgcatcatttctgctaacgagcttgcctccattaaagccactttggtccgtgccgaccttgggatgccttttagatagtacggcgcttgttcacggaattcatgacatccgccccgctcaccttttaaaaccactaaccgctgcaaatgttccattgccgtttgcatcttagccatcggtgtgggtggcgttagtaactccccggttgctaaatagtgtactgtctgggtaagcatccacggattaccttctaccgcccggccaatcatgacggcatcggccccgacttcatcaagcatccgcgcagcatcttgaggtgtctgaacgtcaccattacccatcaatggaatcgtgagggcatccgccacccgttttaacacgtcccaatcagcatggccttggtacatctgcttacgagtccgtccatgcattgcaacggcagctgcaccagctcgttcggcagcccgcgcattctcgacggcatatacgtgctctgcgtcccaaccagttcgcatcttgaccgtcactggtttattaaccgcagcagtcacagccgcgaccatctcgtagactttatctgggcttaaaagccacttagcgcccgcatcagtcttaaccactttattcaccggacagcccatattaatatcaataatatcagcattggtctgctgatcgacaaactgggcggcttgaaccagtgttgctttcgaaccaccaaagatttgaatactcattggatgttcttttggatcaacaaacatcatttccagggtcttacgattatgatacatgatcccgcgatcagaaatcatctcacaaacgactaaccccgcaccaaaatccttgcagattactcgaaaggccgcgttagtcacgccggccatcggtgccactacgacacgattgggaatcgtcacatcaccgatctgccactcttgattcattaagcgtcacccttggaccgtgagagcactgcttctagttcgcgttcactgaactgatactggtccccacaaaaatgacaaactgccgtggcaccatgatcttcatcaatcattgcttgaacctcattgcttgggcaaagccattagtgcttcggcaaatcgttctttagaacaatcgcattcaaacttaactggcattttatctaataccttaacgtcaccatcaaataataaatccaaaatatcttctggtgacttaccatcacgcatcaattgggagactaatggcatgtctttgagcttgttttctagcgagctgatggcttcatccgtcgcatttggcaatacttgcaccaaaaagccaccggcaactccaatcgaattgtcgtcatttacaaacaccgataagccaacagctgatggaatctgttcggattgtgctaagtaatacgtaaagtcttcgcctaattcaccagaaactaacgcaaccgttccggtgaatggatccccaaccctctgatccttagtcacagataaaaagccatcagttccaacagccgccttcacatcgatcttatgcttatcattcaaaggcaagtgcacatgggggtgctgtaaataccccttgaccgtacctttagcattgccatcaacaacgataccaccaacaggaccgttccgttgattttaacggtcatttgttcttcaccctttaaaaccgatgatgctaataataacgtaccaaccaagctgcggcctaacgctgctgatgctgcactccaggtatcatgtcggcgttgggcttcagcaaccacgcccgttgcgctaactgcgtacgctcgaaacatctcattacccgcgacgctttttactaaataatctgccatttaatcatactcctatctcaatccgtctttaattgcgacccgacgctcataaccgaattaacgcaattgatttattttcctgaaatatcataacgcataaaaggagccgagacaaagtcccagctccttcattttactttattcaatactatgcttgcgaattagtatcatcctgcgatgatggtgtggcactttcagcatttggtaaaccagtggctgaagttgcgacatcactgtcggtagctgattcagtggctgaattagctgttgaattgacactactgtcagtactaacttctgaactagcatccgattcacttgggaaacttggttcagcaacactcacattagtcgtagtgtcagctgagtctgcttgcttatcatccgcactttggttttgcgcgtgcttttcagcttcgcgacgttccaattcacgtttggattcttcgaaggtagctgctttctcacttgggaattcattactatccttttcaggcatcttaccagtcttaaacagactgagaatttgcttttcatccaatgtttcgtacttcaataaggcttccgcaattaacttatgctgttcacggtgtgattcgataatatccgtagcagtttgatgcgcttcttggctcaaacgccggacttcatcatcgatcaattgtgccgtatgttgtgaaaaggcactcgcacccataccctgttggtaagctgcttgttggttggcattttctaactctcaacaggaccaagcttttcactcatcccatattgagtaaccattgcccgggcaatttgcgttgcctgttcaaagtcattagaagcacctgatgattgcgccccaaagataatttcttcagcagcacgaccacccattaaaccagccatttgttccttcgcatcacgtttcgacatcaacatctgatcttcacgtggtaacatgatggcataaccgccagcacgaccccgtggcacgatcgttactttatgaacgacccgtgcatcattcaagaccaatccaacaatcgtatgaccagcttcgtgataagccacggtttcccgttcatgcttattcacaacgcgatcatgcttagcggtccggcaatgacccgatcttctgcttcatcgagatccgcagcgtcaacttgcttcttattacgacgggcagctaacaaggccgcttcgttcaataagttttccaaatcggcacccacgaatccaggtgtttgcttggcaatggtttccttcaaatcaacgtcagctgctaatggcttattcttagcatggacttttaagatggcttcccgacccttgacgtctggacgaccaactaagatcttccggtcgaaacgacctggacgaagtaaggcaggatcaagtacatcagaacggtttgtcgccgccatgacgatgacaccttcattacctgtaaaaccatccatttcaactaacaattggttcagggtttgttcacgttcatcatgaccgccgcccataccattgccacgttgccgaccaaccgcatcaatttcatcaataaagatgatagatggggcgttcttcttagcttgttcgaataagtcccgaacccggctagcaccaaccccgacgaacatttcgacgaagtcagaaccagagattgagaagaatgggacaccagcttcaccggcaaccgctttagcaagcaacgttttaccagtaccaggaggcccctcgaggagtaccccagatgggatccgtgcacctaaggacacgaacttccgcggatctttcaagaattcgacaacttcgaccaattcttgcttttcttcttcttcaccggcaacatctgagaaacgaaccttattttgcttactatcagctggttttgctttggtcttaccaaagttcataacccggttgttcccgccgccttgtcctcgcttgtcccatcatcatatagaagaggaataacatcaggatgactggcgcgatgtacattaataacgtgacccagatgccgctagattcttcggccttagccgtaaccttgacgtcatgcttagccgccaacttagaaacttggtcaaccgtgaagttgttttccaacatcgttgttgaaaatgacgtcgtctttgtagatgcgctcttgataccaagggcgtttgcagaagaagtcgtccgtgctttccggtatgaaccagttaccttgtagacgccgccactaggctggatactaacgtttttaacgttattcttatctctaattgtttgacaaattcgctataacgaatattttgcgtttgtgagccggaattaccgccaaagaaaaagtagataattcccatcaagctcagaaacatcaaaatgtaaaataagctattacgaaagagtccattgcgtcgattgttcatatgtgcctccttcatcgaaacttttatatacagtacttcgatagtctaaataatagcacatttgactatcattgaccaattatttatgctcgtaaatcgcgggttttaaaatcccaacgtacggcaagttccgatagcgttctgcatagtcaagaccgtaaccgaccacaaactcattcggtacttcaaagccaatataatctgccttaatatcaacgagtcgaccagctggtttatccaataacgtgcagaccttaactgagttcacatcgcgccgcttcaacaaatcgatcaagaacttcaacgtccgcccggtatcaatgatgtcttcaatgactaacacatcacgacccgtcacatcagcatctaagtccttcgttagttgagcctcaccactagagatcgtttcattaccgtaacttgataaattaataaaatcaagatccgcgtaaatatccatttcacgaataatgtccgtggtaaataaaacggcacccttgagtacgcaaataattaatgggttcttaccagcatatgcagttgtgagttcttttcctaatttttgtgcaacctgatggatatcctcgcgactataaagtactcgttcaatgtcgttgttcatcgtttcagatgtactcctttcaactctcgtgttttaaggctaaaaatactgtctgggtaccagtcgtacgatagctaaacttatgaccgaccacccacagaacgttcccttgagcattcactaacacttgcacctgttcacgccgttcagccggaacttttcgatcaatcagcagtcgacgtaccagctgatgaccaccgcccttgagaacgattcgatcaccagcttgccacggccgccacactagcggccaatcggcttctgttaaccaaaatggctgactgacaacatttggcacccgcgtaaagattcccaccgtttgggttgcagtaattttctgccattggtttaagtctaccataattttttcacggggcattaactttttaccccttttttttttattggcaaagcttcaatgataccagcgttacggtacaactcccaggccgcgtttaccgttaatctactcgtggcgaggccgcgtccgttgtccccacgagaccagcggttgtaacttcgactcggtgaatagttgttgcgtctgctgctcgagccacgtcgcaaaaacggctaactgccactggctcgggagtgcgccccactgatcaacaaccaacgcccctgtggccgttacgactgcgacagtagtaccgtgaccatttgctttttagccgtcaacagcgttgtcaactgttgctggtaatcggccacatgctttaataactggggattaaccgtcataagttctggcacgacacggtgccgaatccgattacgggtcaaggccacatcttgattagtaacgtcttcaaaataaacgacatgctgctcggcagcatagtttcgtagctgatctttcgaccacgtcaacaacggccgaattaatcggcccgttgcaaagggccgactagttgcgattcctgtcaattgtgagatgtcgccaccacgcgcaagcttcatcagatacgtttcgacttgatcattggcgtggtgcgcagtcaaaactgccgttgcacgattttcccgcatcaccttagcaaaaacatggtaccgaaactgacgcccagctgcttcaataccactcttgggatgtgccgcgggtagccaatcggccatgactagcttcaagttttgctgctggcaatattgtcgcaagtagtccgcttccatttgactttgttcgcgtaaatgatgattaacatgagccaccactacccgtggccgttccgctgctggcaatcgttgcaacaaatgcaacaataccattgaatcgaccccagtcgacaccgctaccaccactgtttgctgtggtgataacagtttggctgcagctaattgccgattgaacttttgaattggtgtcatcttaacctcccatctaacttcattataaatacattggatttatttattgttaaaacttgccgattagttggctggtcgtttgtcacctatttgaacattattccgactggatagcataagatgaactagccaagcaagtttacggtaactcacactgtttccaacgtgtctcgctgactgaccttgaacaatcggcaattttcaataaaaaaaagcacggtcgtgactctaaatagccgcaccgtgcttcaaaatttaactagattaatggcaagtcactaagtttagctacgacgaccaccacggccaccacgcttaccttcagtattacgctttaaggttgctagaccgatcctcgctatcttttaagaagccagacatcaatgaatcaaagtcccgcttcttaggttcatgttgtcgtgattggtaacgaccgccgccatttccccacgactatggaaattatttgaccgatcgtgatgattgccattgctttgacgttcaccatgaccatggttgttaccttgatgattgtttggccggttgccaccctgatggttgccatgatgttcatgttcaccttgaggcttgtcaaccgctttacgaattgacaagccaatcttaccgtcatcaccaacggataacactttgactgtaacatcgtcgcccacgctcaagacatcatgaatgtcctttacaaagccatcggaaacctcactgatgtgtactagccccgtttgattattacccaagtttacaaatgcaccaaaattagtaatcccagataccttaccagtgacttttgtacctacttcaattgccataaaaaagttgttcctcctatgaaataatggttttagtatagcatactttgtgaaacgttgagttatacatttaagcaattaataaaaagtggtctactcatataaagcagaccacaaccccgattagttggcagttacatcggcagcattatcatttggtaagctgtagaccgtttcgccactcttcgtataatcatactttgaacgtaataacttttgtaagtaatccttattattcaactgtttgatctgactctcaagttgattatttttttgctgcacctttttaatttaacttgactggtcgcaacttgacggtttacctggtgcagattggaccgcgtattaatcaactgaaaaccaaagaatagtatcaatgctccgaacaccgcaacaatcaaaataaaccgtcgccgccgtacttgtgcaacacgctgggcttgcccatgctcgtcggtggcaacttgacgaatataatcattatctaactgcttgattttgttacgtgacccgttcgtcatgttggtccagtcctttcaaattgggttgcctaaattataacaacttcatcggccggtgtaaacgacatcatgctgattaagtcaacgtttacgaccatttcgatgaacggatacaccgacctaatcactaaatggttggcgataatccgttttgtagtcttcgctgatgatgtcatacatcagctcggcatcatttttcttagttgtttccaataactgcgtcactttgactgttaatgtcttatttccaaaactaataattagttcatcatcaacgctaacattactggaagatttcgctaccttaccgttaatttgaatccgccccttatcggcgatttctttagcaacagagcgccgcttgatgattcgtgaaacctttaaaaacttatctaaacgcatactcatgaatgatgttcctttccttttgcaacggccttaattagccgctttccatatggcaacactaaccactcgcgaatcgtgaataatcgggcatattgacggccccggcaacaaacaccagcacaccgattagcaccccaatcaccgttataattccagccattccacgcgtattcgctagtatcggacctactaaggcggtgatttgatgacaactaaggatcaccacgatacccattacggcacttaatgcgagcaattttatcaaataaccactctctaatagcttttgctgcaagtcttccggcgaacctaaccacatgaccgcaaacatcacggccaagctcaatacggtcaccgcactggcaccgttgatgccatagtggaccacgaagatgtaattagccagcacttttgtcgctaatccagcaatgatgccaatgatcattgccgtatattcgttcaaactctgtaacacacttgtatacgtcgtaatcaacgctgcaaataaaatactaataatatagattcgcaatgccgttgttccttctaatgaaccaaataacaagcgattgatttgtggcatcaacgcaactcagaccgaccgtcgtcgctgccattgataatgctaaactaacgtgaaccatcgcctgtgtctggcgcttgaattcaatcggttgacgcttggctaacgcatccgtcaaagcaggcaataacgttgctgaaaaggccgtcgccaccaccaaccctaactgaaccaaaggttgaccacgatcgtagaccccttttagtgccttggctacttctggtaactgaccttgatgcaccaagccccgcataaccgtaaatgaatccactaattgcagtaagataacaacagcggcgacaagacacagcgtcccaccttcaattacaaatcttttggttaatttgcgataactaggtaacgggtgggtcggtgcgggtgcgggcgccaataaatagcgtagaccaaaaacagtaaaaatcagtgatgaacagattgcagctagtggcgctgaactcattgcccacgttcccatccgataattatcccaaccgagacggacactgaaatatgcgagccatgatgataattgcgacccgtacgacctgttcgatcagttgggacacagcggtcggtcccatcaaaaattttccttgatagtaaccacggccggttgctaaccatggcataaagacaaacatccaagccacggcactaatgattggtgctagattaacgtcacccatgtgggccgcaatccacgttgcaccaagctgcaagccgaaaaagacgaccaacgataatccggataagatatgaaacgcccgccgtgcaatcagcgacttactcgtttcgtctggctgttctgccactaacttagaaataaaatttggaaatccatttaatgcaaaggtcatgccaatgccgtacagcggataaatctgctgataaacgtaaaatcccgtattaccaaccatgttctgtaagggaatccggtataccgcgcttaaaatcttagcgactaatgatgatatcgataaaattaacgcacctttgaacacggtgttcaagtgatcctttggcataacaaatcccttctaccgagcaactcggtgtctcatactaattcatttgagccgtgccctgactagccaggacaacgccccatcagacgataattcacgctatttgccattggttccactcgatagcgcttaacccaccccgtgcaaccatgcttcataacaacaactaccgagctaagacgcactagcgacatcgtcttcggctaagatcaaactcagttgttcgacaaactgtgttagttgcgccagccactcatcctgttgcatctttggctgaatgactaatttaaccttcattttatcatcatcaattccaactgtcgcttttaattttgtttttgccaaggccttaaaaatatctttagtatctagcttagccgtcccttgtttggataacgttaggtgtagctcactatcgtcacgctgaatcttctcaatcagcgcgtcatccgccaataacttcagcttacctactgctaatagtccagcgacttctaccggataatcaccaaaccgatccattaaatcatcctgaacttccatgtactgatcattattctccagctggcgaatccgtttataaatttcgatcttttgccgttcatcttcaatatagctggtcggcaagtaggcttcgattccaagttcgaccgtggcatcggtcttaactttagccgcctgaccacgcttcttcgccactgcttctgacaacatctgggtatagaggtcataaccaactgagtcaataaagccgtgctgttgcttacctaacaagttaccagcaccccgaatcgacaagtcgcgcatcgcgattttaaagccagatccaagttccgtaaagtccttgatggcctgtaaccgtttctcaccaacttctgtcaaaactttattttgctgataagtaaagtaagcataggcgacccgactactccgaccaatccggccacgcaactggtatagctgtgacagtcccatccggtcagcattttccacaaataaggtgttgacgtttggaatatcaaccccggtctcaatgatcgtcgttgtcactaacacatcgtactcaccccgaatgaaatcgtagagaatcccttcgagttgtgactcaggcatctgaccatcaatatgggccaccgccgcgtcaggaaccaagtctttgatctgtgcaacgactttatcaatatcatgaacccggttatgcaaataaaagacccgcccattacgttgcatttctcgttcaattccctctttaatgacgccaaaattctgttccatgacgtacgtttggatcggataacggttcgttggcggcgtctcaatcactgataagtcccgtacaccgagcatcgacatgtgtaatgttcgcggaatcggcgttgccgttaacgtcaagacatccacactagccttcaaggccttcagtcgttccttgtgcttgaccccaaaccgttgttcctcatcaataatgagcaggcccagatcagcaaacgcgacgtccttagacagtaagcggtgcgtaccaaccacgatgtcaatttcaccactctttaactgttggaccgtctctttcatttccttagttgttctgaatcgtgacagcatgccaacgttaatcgggtagccttcaaaccgattcagcatcgtttcataatgttgctgagctaaaatggtcgttggcactagaaaggccacttgtttgccggcctcaatcgccttaaacgcggcccgcaacgcgacttccgtcttcccataaccaacatcgccgaccaataggcggtccatcggtttcggtcgttccatatcatgcttgatttcattaatactacgaatttgatccggcgtctctgggtacggaaaatcgttatcgaaatcatcttgataactatcgtccggtggaaaggcgtaacctttctccgcctctcgcttggcatacaggtcgactagttcatccgcgatatcttcaattttcgccgcgactttgcgcttcgctttcgtccattcggtaccacccaacttattgatgcgtggcgtctttgattctgacgaaacgtacttttgaactaggtttaactgggtcacgggaataaagatcttcgcattattttgatacgcaatcgtaatgtagtcttgatggacaccatcaacttccagcgtctccataccaacgtactttccgatcccgtgattgacgtgcacgacgtaatcgccgggtttgagatccgtataactcttcaaccgttcggcattagccaaggtctgacgacgtggacgcttcttagccaccttcttgaacatttcttgctcggttacgatgactaatttaccatccggaaactcaaatccattttgcaagctaccttgcacgatttgaaccgcacccggttgtaaattagtggccttagtcatgaccgcttcgatttcaaaatcatcaagcgtatcactgacctttgtcagacgctcagcctctgataccatcaagatccaccaccgtctgtttaagcttatgccaccgatccagttcggtcttcaacgctgggagctgcccaaaaattctgcatcgggcgtgtgcgcacgttagttacttgcgctagtttgacgttgccgatacccttttgaaacagcgaaatcaagagttgtgcatgttggtcatcccggagcaaatcccgaatatcattgccgtaactcgcagttgccaacacccggtgatgtgccaattggtctgtaacccagtcagcttcttgcgttaataactgctgctcactatcaagcaaacgcgaatattcttcgaagataacgagcccgtcagcggccacatagtcaaaaatactcgttttccggtcgtataaataatcgccatataataataaatcgtttccgataattcctttttccatgtcagctaaaggttgtgctaaattatcggccaaagtctggcgttcggctggcttgagtttcttactttcagccgcaatcgccgttttagagacgctgtgccccggcccgcagcatagctgatgttaggataaagtcggtagctggtaaaatcgtatactcatccaagttttccaccgaacgttgcgtttccgggtcaaaatacttcagtgtatcaacttcagtatcaaagaagtccagtcgtaaagggtagtccgcatctaacgggtaaatatccacgattgagccccgtaccgcaaaatctcctgggcgtgcgactaacttttccttaacgtaacccatgttgtgtagttgccgctgcaagtcttccaaatcaatatcttgaccaacggctaccggtaacgtggctgcttgaaattgtgcgacgggcggcaagaaccgccgggcacaccgcaaccgaggtcacgaccactgccggactgtcacgcaataaggcgtttaaagcctggacccgttgcgctcgtgactctggtgaacttgtcgcaacctccgtcgcaatcatttcttcagctgggaataaaaaaactttggtcttcatctaagagactcgttaaatcatccactagctgactcgcgtgaaaaccgttatcggtcacgatcagtaatgaatgcgttaattggtgaaatagcgcgcttaaataaaccgttcgtgccgaaccgttcaatccggtgattagttgccgactacgcgggctgataccgctaaaattgtttgaaagtcgggcgtttgctcaacaatcgtttcaatatccattctgtcgtttcctcccgggctagttatattgattcataactgccgcaaaatcatcatttgctaaccaagcttcgaccgccgctagcgccgtaatcttagcatcgtcaaactttgccacttcggctggcgtaaattttcccaacacgtaatcaacaacactcatcttctgaggatggtcaataccaactttaacgcgcttgaagtgctgatcgccaacatgactaataatgctcttgatgccattatgaccacccgccgatcccttttgcttgagtaggcgtacttttcctaatggtaaatctaaatcatcatgtataacgagcaaatcagcgggatcaacattgtaatagctcatcaacggtcccaccgctcgtccagaatcattcatataagtggcgggtttcaccagtaaaatcttcttaccgtcttgaaaagccgttgccacctgtgcttcaaatttactcgtttgaaacgtaacgtttagtttgctagctaattcgtccacaatcataaaaccaacattatgacgtgtctgggcatattgccgcccaatgttgcctaacccaacgatcattttcataattttatcttctcctattactttgcataccaaaacaggccgaaccggtaatcgacccgattcggcaactctgagtaacgataccacctaagtcgtattggcaccactactcacaccgtgaccgacgcgcccgccagtcaagtgttcaaaagttagcgtttattaagtgcgataagtataccacaaagggctttattgacgcccgccaaagggttttgcggacattgttaataattgtattaaaagcatgctcaatctaacacttattttgcacaaacatggtatactttaaccgtaaaaactaaattttcactacgagaggatgacttattttgtcaagcatgccaaatcatcaaaaagttgtgttagtcggcgacggcgctgttggttctagttacgcttttgccatggcacaacaaggaattgctgaagaatttgtaattgtcgatgttgttaaagatcggacaaagggtgacgcccttgatcttgaagacgcccaagcattcaccgctcccaagaagatttactcaggcgaatattcagattgtaaggacgctgacttagttgttattacagccggtgcgcctcaaaagcctggtgaatcacgtttagacttagttaacaagaatttaaatatcctatcatccattgtcaaaccagttgttgactccggctttgacggcatcttcttttagttgctgctaaccctgttgacatcttaacttacgctacttggaaattctcaggtttcccaaaggatcgtgtcattggttcagggacttccttagactcttcacgtttacgcgttgcgttaggcaaacaattcaatgttgatcctcgttccgttgatgcttacatcatgggtgaacacggtgattctgaatttgctgcttactcaactgcaaccatcgggacacgtccagttcgcgatgttgctaaggaacaaggcgtttctgacgaagatttagccaagttagaagacggcgttcgtaacaaagcttacgacatcatcaacttgaagggtgccacgttctacggtattgggactgctttaatgcggatttccaaagccattttacgtgatgaaaatgccgttttaccagtaggtgcctacatggacggccaatacggcttaaacgacatttatatcgggactccggctgtgattggtggaactggtttgaaacaaaatcatcgaatcaccactttcagctgacgaactcaagaagatgcaagattccgccgcaactttgaaaaaagtgcttaacgacggtttagctgaattagaaaataaataatcatttcatacgattaaatgtatgatgaagaggctgtgacataactagcctctgtataagcaaatgggacgagaaaccgaattttggtttctcgtcccatttgcttacgcctttgatttttaaagttggtccctaccgtgaccagtttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgaccagtttctggagctgaaagtaattctcgttgtttcgatttgaaatattcccaattttcgttcacggaaatccttttaagatatccttttggtgttagatgccgcgcggcaattagttgatgattttcatcatacttttcggcaatgtattctttaaagtcacgggtaaaaccatacttatcagtccgtcgacgataagcattaaaattaaaccggacgttttgcggattgataaaataatcatctttttcatgatagtcccagttcataaccttacggtcatcactttgccattttcgactattctctttaagcattgtgccgtagggaatcaaaacggtatgctgaccgaattcatcttccaagtaccgataattactttcggaaccgtatccggcatcggtaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcgggttttaattgaccgttttgcatcggatcttccttgacccgcataaaggtggcatcatcgtgatccgtcttagagtagctgttacgctgaccatagattgcttgctgtgcttggtgttcacgcattttatcacgtcgtttatccaacttacgtttttgtgatttaacagtccggcgttgctgtttggctgggttcggggaaacccgcttagttgcttccacggtttcattaaggaccactaagtgatcctcaaccttgctaatcatgatatccaatagttcgggagtcagctctgatcccgccggaatttcaccgacaattttagcttcatgaagctcgcctaacaggtcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagctatcggttgtcaaagtggccagttcatcagaaattctaaagcgacaaatcgtctccggtaggacggaatttggtcggcaattaaccacccagctggcttgttttcacgggcaaactgttcaattttacgactgctgaaaatgccatagctgtacgctaaaaggaccaattttaacatggcaccgaggttatattcccgcggacggccaaactggtaatcatattttagttttaaactctcaacaagctggttgatgtaacgagcagaatgatgctcttctggttggtaatccaaggcgatactcaaagtggtttgattcatgttataataatcttgcatattaggaatgtcctttcgaggataatttcgtagagtatcgggtgcgaccgatgctcttttttattttctattatatcaaaagcgaggtctggaaaaattcgaagatttttccagacacgctttgtttctagagacttatgtcacagcctcttttttgcttgagggtaccttagcgattcattaaagcgcaacacgcactaaaggctatttttacttaaaactttcttatcacgattaccggccttgaagtttgcactcatctcacttctgttataaggtgagaatattacgaatatatggaggaccaacttaattatgaaacataaacgtggacttatgattgggggcagtatcctcggtctcctcgtcatcggatatgttgccacgagcttaatctggcaacatcaacaaacgttcctcagtaatacgtcggtcgctggtgttgacgtcagtggtaaaaccgccgctcaagcagcaccgaaagttaatcgcgctttagaacatcgcacttatcgaattattgaaaacggccaaacaaagtactcatttaccagcaaatcagccggtattacaatcaatactaaaaagatttaaccaaattagtgaccaaacaaaactactggcgttggccccttgcactattgcaatcggctcaggctgatgatagctcagcggttggacaactaaccatcaatcacactgatttgaaaaccctactactacaaaaaatcaccacgactgccaatcaaaccaaacgaacaaaaactgaaaacgccaagttagtttatcaacataaccaagttgagattaagaaagaagttcaaggaaccgaattagatcaagctaaacttaagacggtcgtcaccaaagcaattagtaatggtgacagtcatatcacccttaaagacgcctacgtcactccgaccgttaccagcacgagtgctagtttaaagacggccaaagtaaaatcagcgaaatacgctaccgaaaaggccacctataatatcaacggtcataaattcacgattcctcacgacctaattctcagttggattaaagtcgataagcaaggcaaagtgagtttagaccaaaacgctgttctgacttacgtgaagcaattgaatgataagtatcatacctatcatacgacgcgtcagttcaagagtacggcgcgtgggaccgtatccgtcagcggtgggttttatggctggaccatcgtaagaccgaagcagaggccaaatcccttgctactgaaattttgaagggcaaggactttacccgctcaccaatcaccagtggttccggatataacaacaagggcaccgacatcggcaacacctacgtcgaagttgataaagaaaatcagcatatgtacgtctacgttgatggaaagctcaaagtttcaacggacatcgttactggaaagcccggtaaacacgctacaacaacgggtgtttggtacatctggaataaggaaaagaacgcgacccttaaaggtgataatgacgatggctcaagttattcccaaccagtttcttattggatgccgttcgatgacactggcgaaggaattcacgattcttcatggcaaactcaatatggtggtacttggtacaagaagcacggctcgcatggttgtgtgaacaccccaccttctgtcatgaaaaaagtttttgctgccgtgccagtcggaacaccagtcattgttttctaattttttaaatctaatttaaccaagccggtctgaatgttatcaggacggctttttcattccttttagccgtcgtttgatgtcataatgatacgtgtaagcggtcgttttatggtattatttattaaaacaaactaataaatctgggggaccaactgctatgctattaaaaacactcgtaaagcctaaagaacgcctcgtcaccattacggcggacgcgaccttagaggacgccttaaaagtcttggaggattccggcttccgctgtattccaatcttagatgaaaccggtcatatcttccgcggcaacatctataagatgcacatctatcggcacaagtcacggggcggcgacatgtcgcttcccgtgacgaccccgcttaaaaatgccacgaaaacgattcaagtcgactccgccttctacaacatcttcttctccatcaaagatttgccatacattgcggtgctcgatgaacacggctatttctatggcattctcactcatattcgcgtctgctcgacatgctctcacaatcttggaacgttaatgttggtagctatgttttaacagttgtctccgttggtgaacgtggtgatcttgcagccatggctaagattatcacgaaatatacttcaatcgccggctgcctgaccctagacgtccaaaacgggacactcggttatcggacgctctttaccttgccagaaaatgtcgacagtgaaaagctcaaacgaattatcgacaacttgaatcgcaaacaatttaaagtcatcgaagtggaagatttacaagctgaataatcacagttgccccaaggttaccttggggctttttaatgagatgaattttcagatcaaaagcgaccagcttaagactgctgaaaacagttcgaattagcgtaaacctgtctggctgaagcgtcctaccaccgacttacaggtatttttgtcaattgtcggaacgtggtgggcgcagatttgagtcaaaatatcgcgtctcaaggatgctggccgttcactccctaatgccatattgacgaaacgtgttcgggtcagctgtgttccagcaattggcacccagctccggaagtcttagtagaacacacactggaatcttgatgaagcattaaattatcgctgactaatttcaaactatttaaatctacttgctaattttaacgaccaatatcatttatctaaaatcgtttgacaaacataatagtcaatgataaagtagtcaacattaaataaagattagaaaataattaaacgcgacgattaggaaagtagcacttaagcaattgttcagagaggttccggttggtgaaaggaattcatattgctatcttgtgaaaatcccctaatcacggtaagtgcgatcattatttgtgagtacttaatggcagcatccattatcatgctagcgcatcgtcacttaacttaccgtgcgtgaagtgaggccagtttactggcaaataataggtggtaccgcggaaacgccctatatcaatcaactacttgattggtatagggcgtttttattgtctaatcgaaggaggaatttctatgttaacaggaactcatttaatacagctaaaaaatggttttcatttatttactcggacagttggtcacgggccagtcaaagtattatgcgttcacggtggccctggtagtaatcatactgaatttgaaaactttgccactgagctaggtgaagaaaattttcaaatcagcatgtatgatcaattaggctccttttactcagatcaacctgacttttcaaggcctgaaaatcaacagttcttgtctttggattattatttgtctgaattagaagaagtccgccagcagctcggactcgaagacttttacttacttggtcactcgtgggggcttattggctcaagaatatgctctgaaatatggtcagcacctcaaaggcttaattatcatgagtatgattgataacatcgctgaatacacaccacacgtcaataaattgcgcgaacaaacgttaatagcgagccaagttagctatatgcaagatattgaaaacgcggaggcctttgatgatccagaatacaaaagccttgtcacgactctcaaccggcacttcgtttgtcgtcatccggaaaatgcgcctcgtcaattagtctcaacactagctacccctgtttataattattttcagggcaataacgaattcgtgatggttggggcattaaatggctgggatcaacgtgcaaacctccataaaatcatgacacctactttactcacttttggggaatacgacacgatgccgctatcagttgcccggcgtatgcagcgaactcttccaaaggcacggttaactttaacgccagatggtggtcattgtcatagtgtagataatcccaccgctttcttccatagcttgagacgctatctcaccgatgtcgaaaccaatcaatttacagcatattaattgaggaggaacgctaatgttgatgaaaaaatctgacaactattagttgccttttactagtactaagtaatctaaccgcttgtgggcaagcacatgccaatgtcacaaccaccaggaaaaccccgcatttgatgcgggatagtgaattaacctcattggatacctcaaatacagccacacttacacaatggaacgtcttacaacaatccatggaaggcctctatcgcatgaacgctcagaataaagtggtcggtgcaatggccactaaagtcgttaaaccaacaaatcatggcaaaacctacacctttcacttacgacgaaatgcaaagtggagtaatggtcacaccgtcactgccaaagatttcgtaacagcttggcaacgctctgtcagtgccacttctacctctggttatagttacatatacgaaggtatcaaaaacgctgctcaaatttcagccggacataaatctgttaaatcattgggcgttactgcagtgaataagcacactttaaaagttacgctcagccacgccatatgccatacttgagtaagatgctcaccatgcccgctttctttccccaggatcatcaagtggtgtccaaatacgggaaagattacggaactactagtacaaaaatggcctacaatggcccgttcgccgttaaaggttggaacgggactaatgattcttggaatttgttaaaaaatacatactattacgataaaagtgacatcaagttaaataaaataacaatgcaagttgtcaaagactccacaactgcccataatctcttctcacaaaataaattagatgacgctactgtcaccggcgtcaccgcgcgggtgttcaaaatgactcgcatctgaaacacgtcagtaaagctggcacttattatttacgtctcaacatgcaaaaaaatcgggctttaaacaatcaatatttacgtcaagccttgaatcttgtgcttaataaaaaaacactcaccaaaaatattttgagtgatggttcaacacaccgcttacaattatgtcacacccaggtttaaccaccgatcccactacgggcaaggattttggtactgaaactcaaagcacctaccgacacaatgttgctaaagcacaagtattatggaataagggtctcaagcaacttgaccgttcttctgtaacattaaagctagttagtgatgacacgacggtcgctaagaatattgaccagtttgttcaagccgctgtagcacaaaacctgaaacatgccaaaatgtcagtttcagcgataccttcaaagtcctccggcgaagcagttactaacggaaattacgatttgacttatacactctggctagcagactacgcggacccgatttcctttttcgacattctgacaaagaacaatccgcaaaactacgggcactatgatgacactgttttcaatcaacaaatcaccgctgcacacaaccagaacgcaactaacacacactcatactggcaaaatatgagaactgccgccaaacgtctcaaccaaacagcagcagtcgtaccgctttacaacatgactgaaagtcaccttgtaaattctaatttaaatggtgtcagctatcatgcggttggcgaaaacgattatacgcgtgcttacttcaaataattgtctgggttctgaaatgaacaccagtcattatgcactatatctgcccataatgaactctcatcgccaacttcactatgagtcgattagattattttgttcaactgacatcgtaatgactcgacaaaaaaaccattatttcaatgactcatccttcatcgaaataacggtttttagtctgatttgtaaaaatcacaccctactgaatccggtcactaaagtgcaagacccgatccaagctgtacataattggcgcggtgatactcatgataatcaactctgataaagcagttgttagatacgtcggccagaaagcgacgccgctactcatcatggtaatcatcagtgcgatcataaacatcgaaacggtgaatagcgcgatattcagtaacatccgttgccaaaccgtcttcaacttaggggccaaccacgtcaataccagcggggctaataatgattggccgccaccaaagagaacgttgaggagactcgcaccgggaccaaaagcgtcaaacaaaataacgccagcaacaattccccaaatatacttgcgattgaacacggctaagtggttcaacccttcagaaacgcggaattgaattgcgcccgatgccaagctaaaagctgcggggcctaggcataatacaacatacattgcagcgactagggcgttgataatccatggtcgaatttttgattgtgtcattcgcttaattcctcctagtttttttaacgtgggatggttacgaaccacgtattgattgaaacaaagcgaatataatcgtagcacgctctagtagttcccgcaagcttgctaattgaaaatgctggtaggaataaataagttacctaatgtagccgccattaccgccttaattgctggcatcatccggttgccggcctcttcaaagacgaccgcccgcttactctggaagacatcatccgtaatttcaaacgccgtcattccgtactgttcgcctaatttggctcccagctgcgtctttagatcgtgtagtgctggtaagcaatgcatgacaatcgtcgatgacttgccagtagctgcgagtaacgcagtattaatttgaaacggcaatagttgcttgatccgctcaccatagtcgacccgctcgcccattgagacccagacatccgtataaagcgcatcagcctgagtaacggcttgttgcggatcagccgtaatcacgaccgtgctcccagctgcctgcgcatactgttgggccaacgcgaccactgctggggctggctgtaacgctaccggggccccgatagcgatattgatgccgagcatcgctcccgccacaagtaaactattagccatattattgcgaccatcaccaacgtacgctaacgtcaacccttttaaatgaccaaaaatgttcctttaatgttaaaaaatccgctaaaatctgcgtcgggtgccactcatcggtcaatccgttccagactggcacaccactataggtcgctaagtcttcgaccgtgctttgtttaaagccccgaaattcaataccatcatacatggaccccagtactttcgccgtatcaacaactgactccttcgtcccgaattggatgtcgtccttacccaaaaactctggattcgcgcccagatcattagccgccacagtaaacgcagaacgtgtccgtgtcgacgttttttcaaacagcaacgcaatattttttccttgtaaataagggtgtgggatatggtgtgctttaagggtcttcaagtgactagcaaagtcaattaagtaagctaattctgttggtgtatagtcgatttccttcaagaatgaccgaccttcaaattgattattcattcgtcgtgacctccgttgtcaaagttgtcagtacctttgcaatcaaggcaatcccagctaataaatcggccggttgcatcacaattggggtaacaaacgtaacgtattatcgccagctgataacgtcaataagccttctacttgtagccgggtaatgacttgattaaccgggatttgttcatctaagtggattccaatcattaggcccttcccgtgatttgtttcactaccggtatcggttcgacttgagtcgctagggcttgccagacaagttcggcatgggcccgaaccgtcgttaacagcgccggtgttaattgggtcaagacacgttttgccgccgccatagcaacagcattaccggcgaacgtcgagccatggctgcccggaccaaaggcagtggctaattgccgccgaccaaccattgcccccactggcaagccattcgctaagcccttggcgaccgtgtagatatcaggatccaggccgtaaccttcataggccatccggtaaccagtccgaccgattcccgtctgcacctcatcaataatcaaacaaaacacccgttgcttggcatttcgcattaaccgcttgtaaccaagctgtttgtcccgcaaagacgccgccttcaccttgaacgacttctaaaataacggccgccaactctggtgtgattttgtccaaagccgcgtcgtcattataggttgcaaacgtgatgccaggcactaatggcgcatagccagcctgaatatgaggattgcccgtcatcgacatagcgccataggttcgaccgtgaaatgaatgctgaaaagctaagatgccggttttacccgtgtacttccgtgcgagttttaatgcagcttcattggcttcggttccggaatttgcaaagtatacgagtcgctcttcaccattcgctaacaggccggcaacggcatcttgtaattcattttcgtataaattcgacgtatgccagatatgcgtcaactgctgggtgacggccgcctgaatttgtggttggtgatacccaaagttgcagaccccgattcccgccgtaaaatctaaatacgtcttgccatgattatcagtcagatgaacgccctgaccatccgtaatggcaaatggaaaacgttgataggttggaaacacgtgttgcatggtcatacggccacctcctgaataattgcggttcctggttgatcgattgcattcgtaataatagcccgcttgactcccgtctgaatcgcggcaattgcagcttgaactttgggttgcattcccgcggtgatcacagctgttcgaatcaattgctgagcttgttgtggcgatagtgatgtcatcacattaccgtgatgtataattcccgggacatcggttagcaaaaccaatttttcagcatgtagttgttgggctagcacggtcgctgccatatccgcattgacattgagccattgtcccgtctcggttaaggctaaaggggccaaaataccgatatgatgagccaacaattgcattaattgcacttgattgacagcggtgagccggccgacataccctagctgtcgataatcaatcaattcaccagttagtaactgattatccgccgcattgagccccaacacaggtaggtgatgttgcgttaattttgcaagtaaggctggttgcgcatctcctagcggggccaacttggtgagcactaaggtcgccgcatccgtcacccgcaacccgttcaccttatgcacgggcaaagcaagctgagtcgtcagtcgattgatcattggcccccaccgtgtacgatcagaatctgataatgctgttggtaccactgtgcgatttggtcaaagaaagtggtgctcaattggctaatcgcctggcccccaatcttaattacaattaattttgtcattttcaccacctccgtttaagtatgatagctcgcgttaattttgacgtaattgtaagtcaagtcacaaccccaagcctgaccacttgctgtaccgtgatgtaaatcaacatcgatcataatctggttatcacgtaaggtcgcacggcttttgcaccgctgccatatcaaagtcaacggccagactttgttgaacaagtaaaacgccgttcatttcaatatcgaccgtcgccacatcgatgtctgcatcagtggcgccaatcgtgctaatgattcgcccccaattcgggtcttcaccgaaaatggccgccttaacgaggttagagccaacaattgctttggcgatttgctgaccatcaaacgttgtagcggcgtggaccacattacattcgactaacttggtcgcaccctcaccgtcagcggcaatttgcttggcaagttggcctaagacatagtgcaacgcctgattaaaaatatcatagtcggtggtacccacttgtaaactcggattatctgccagaccattcgccaacgtgaccaccatgtcattagtagacgtgtcaccgtcaacagtaatttgattgaatgtctgatcaacgttagtacttagcatgtcctgtaaaactggcccgtctatttgggcatcggtggtgacaaaaccaagcatggttgccatcttgggatgaatcattccagaacctttggcaaaaccggtcaaggtaactaactggccgctgagttcacactgcacacagacggtttttggatgctggtctgtcgttaacacggcgtaggtcaccgcgtcactcttcgttggtgtcaattgcggcaagccgtttttgattttatccatgggtaactgagcaccaatcagcccagttgaagcaacgccaatcaagttcggcgccacgtttagtttattcgctaaccaggcttgttcttgcagcgcattctgccacccccgctcgccagtacaagaattggcgattgcactattcagcagcagtccctgtaattggtggccctggtcgatcatctgtttagttaacttagttggtgctgcctgaaactgattcgtcgtataagttccagccgcactggcggcacttttgaaaatagccaaccaaaatctttttatgacgacgacgaagaccaatatgaatgccatcactgtaaaaacccgccggccactgaaaggcaaccgtttcaaacttcgtattcgttaaaacttgcatctgcataacttcctctcttattgcaccttatcagggaaatacaggtaacgtcggtaatccggccgtaaccgcgaaatcaaaatagcgattaaaattctgaacggcccgccccgcagcacctttcatcaaattgtcaatgacgctcacaaccacgatggtgttcgtgaccggattataatcaacgcctaacgcacagttattagacccaacaacgtccttgagcgtcggcatccccgttggtagcacttgcacgaacggctgctcatgataggtcgcggtaaaagctgcccggactgcgtcgttgtcaatgctgacttcgctttggcataaatcgtcgtcataatcccacgcgttactggaatcaaagtggtagtaaattcaatcgcagaaatcgcggaccaccactgctgtaactgttgcatcatttcagggatatgttgatgttgattcaacttatataaactcaaattatcattcacagcgacgtaatgactcgcagctgtcgctcgtttgccagcaccagataagccggacttagcatccacaacaatcgaagtcggttcgaccaactgctgctgagcaagtggcgctagtcctaataacgtagcagtcgcataacagccgggattcgcaatgtaggtggacaacggcgccggcatatcagctaagccgtagctcgcctgtgccaaagcggtcgccggtgctggatcacgttggtaccaccgctgatattgctctggatcatgcaagcggaagtcaccagataaatcgatgactggaaaatgagcagcgatgaatggtaatgccaattgtcgcgtgatacccgctgatgtcgcaaagaacacaatcgcgttatcgcgcatgattgccgtcgcatcgaatggtcgaataaccgccgtttctttctggtacatatggctgccaccgtctttaatgccaccgtagttgctcccacgtgcccgtataattggatgcgatcgatctcgggatgttgtttcaagagccggtacaacaccatgccactgtaccccgtaacgccaactagcgcgacttgcatataatcacctcaaatattcaaaaatagtgtattagctgcatgttcatgcagaaagtatgattcacactatattctcatcgcttttaaattgcaagctttattgaaaaaatattcatttttattctattaattgaatatttttagctttattcagtgatttatgcatttaatatgtatttttaattgacatccacaataaaatgatgtttacttatcccattaaccaaaatgaaattttaaccaaattatcagaaagggtgcgattgggatgaacaaatacttaactttagcagacggcacacagtggattggaacggcaattggggattgccagctagaggctgcggggcgcatcgtcttcaatacgggaatgacgggttatcaggaaacattgactgatccatcctacctaaatcaaatgattgccttcacttacccattaattggtaattatggtatcgatccgaccgtggcccaggcaccaacgattggcgcacaagccatcatcgttcacgagctggccacttttaatgatcactatactagtcgccaatcactggcaagttttctgacaatccaccatgtagccggcattgaaggcgtcgatactcgtgacctaacgattcacattcgccaaacgggagcccagatggcaatcttgagcaatcatcccatcactgattttgaagcgcaactcgccacattcgcaccccaagtactaacggctaccccctcccagtagcgacgaccaccatccgtccacgcgtcgcgattctcaactttggtgaaaaagcagctatcaccgctgaattgcaagcccggggcgcggacgttgttgtccttccacctacagctagtctcaaggccgtggccgcgtatcaccctgacggaattttgttatccaacggtcccggtgatccgaccgactatcacacttacttagcgaccattcgccaactcgcacaacgttatccgctggctggcatttgccttggtcatcagttgattgcgctcgcctatggtgctcagacttaccagctttcctttggtcaccacgggctaaaccatccggtacaagcctgcgctgacggtcgtattataatgacttcgcaaaatcatgattacgccgtcgatccggcatcgatcaagggcaccccgctgatcgtcacgcacactgaattaaatgacggcagcatcgaaggcttgcgcctaccgcaccaggccgtaatgtcggtgcaattccatcccgaagcacacccggggccccaggaagctgggcaatttttcgatgatttcttactaacaattcaaaaggaggcggttgttaatgcctaaaaacaatgccattcattcgattgctgtcatcggttctggtccaatcaaaatcggtcaagccgctgagttcgactatgccggtactcaggcttgtctaagccttaaagcggccggctatcatgtcattttgatcaattcaaacccagcaaccatcatgactgacacggccaccgccgacgaagtctacttagaacctctgactttgaccagtgtcactaaaattctgcgggccacccaccctgatgctttgctcccgacacttggtggacaaaccggattgaacctagcgatggcgttagatcaggctggcgttcttaatgagttgaagatccaactgctaggaacttccctagccaccatcaatcaagctgaagaccgggcagcatttaaaacacttatgaagcggctccatcaaccgattccagcaagtaccactgttcaccacgtgaccagtgcattgtcgtttgctgaaaaatcggttatccggtcattgttcgtccagcctttacactcgggggtttcaggtggtggcattgccaataatgccgccgaattgacccaaacgttacagcgggggctgaccatgtccccgtcaccgagtgcctgattgaacaaagtatcgccggcttcaaagaaattgaattcgaagtcatgcgtgataatcagggtaccaagatcatcgtctgttccatggaaaacttcgatccggtcggtattcacactggcgattctatcgtgtatgcccccgttcagactttgactgacactgaatatcagcagctacgaacggcaactttgacgattgtggaagccctcgacattagaggtgggtgcaacgttcaactcgctcaagacccgaatagtcgtcagtactacgtcatcgaagtgaacccgcgggtcagtcgttcatcggcgctagcttctaaagcgacgggatatccaattgccaaaattgcagccgatatcgcaattggtctaaatttatctgagatcaagaatccagtcacgcagacaacctatgcggcctttgaaccagctttagactatgtggttgccaaaatccccggtttgcgtttgacaagtttccaacggccgacgctcacttgggaacacagatgaaagccacggggaggtcatggcgattgggtcaaccttggaggaagccacgctcaaggcgattgcttcgcttgaaatcgatcccaagatccaagcttccttgacccctgaccaccacgtcaccccgactgaatatatcgaccaattgtcccacccgacagatcagcggctcttctatctattggcggcgctgcaagcgggttggccgttagcaaaattagcgacgctaacgcaaatcacgccatttttcttgagtaagttacagcacatcgcccaactcatccggaatatcaagcaagtgccgacgtcccaacacctcttatcggcgaaaaagtacggtgtgagtctggcgaccatggcgcattatgcccaaacttcggtagcgaccattgctgccatgatctgctgatttacccttcgtttataaaatggtcgatacgtgtgctggtgaatttgccagtgttacaccatatttttacagcactgcttttggacaaactaacgagagtcacccactaggacacagtattttagtactcggatcaggccccattcgaatcggacaaggcatcgaattcgactacaccaccgttcactgtgtcaaggccattcaacaagctggctaccatgcaatcatcgtcaataacaatcccgagacggtctccaccgacttttctacctcggataagctttatttcgagccactaacaatcgaacgtttgatgccaatcattgcgttggagcaacccgcgggcgtcatcgttcaatttgggggccaaactgcgatcaaccttgcccatcagctcactaaattaggagtcaccgtcctaggaaccagtgtgtccgctaccgatttgaccgaagaccggcaatcttttgcggactgtttacgtctactaaagattgcccaagccgctggaacgaccgtaactgagttatccggtgcccgtcaagcagctcacgcaatcggttaccccttactcgtacggccaagctttgtactcggcggccgggccatggcaatcgttcataacgatcatgagctcacgccagttattaaatcagcggtggcagctggccatggtgcgcctatcttaatggaccaatacttggcgggaaccgagtgtgaagttgacgttctctccgacggaacgtcgtgcttcattccaggaatcatggaacatattgaaggtgctggcgttcattctggcgattccattacagtctatccaccacagcacctcagccccgctgttcaagataagatcgtcaccattgccaccaaattagcacaacacctccactgtgtcggtatgatgaacattcagttcgtcgtcaccgatgatgtctacgtaatcgacgttaatccgcgggcaagtcgaacagttccttacatgagcaaaggttactcacttgccactggcacaattggcaacccggctaattctcggtcaaagtttagcaacccttggcctagtccccggactcttgacacccgctccacaacaaattgctataaaggccccagtcttctctttcaataaattgccacaatcaccagtcgttttaagtcctgagatgaaatcaactggtgagactcttggtatcggcccgactttcacgaccgcttggcatgccgccatggctgatagttatcacttagagacttggcaaaccgtggatggtctcatcaccgatattgccactgtggcgcaacccgcggtccaggaactgttcgcggctaaccacctcaccgtcacaacgatcgctaacacgactgattggcccgcaaagactaaagcagtgggtttcacgcttaatgaccaacctgataatcccgtggctatcgctgcattgaatcatggacaaccattgattacggcgattgataccttaaaaacagcgttattagcagtaacaccaaccccagctaccatctaacttgtttggcagcactaaaataaagcacctatcaattttcgataggtgctttattttggccttagccatttcatttgagcgaaatctccaaatactgataatgtcgttaacgttgtctttcagtgatcggcaacgccgggatctcgttgaatagaattggaacggtttcaagagtcacctcggagaattctaggccgaaccatttggcgggcgttgtcgcgtatttttaatcattaatttcgtctcgatcactaatcgatccaagcgggataaccgactaccattttctaacttctcctcgatgataacgaagcggaagtcaccgacatcgcggccagaagtgactgaatatgtctgcttttgcgccgctaaacgtccagtagccattaagtcgcggacaatcgtccgtaaatagcggttaatatcttggcggacacgaaagcccaggtataacttaacagttagccaaatagtccgttgctaacgtgtcaacagtatactccgcggtatacggttcatccgtgattgtcacattaacaaaccagtagacgtcggcacgtttcggccacttgtctaaaatcgaatataatacctttcgctccacttggtcgccatccattcggcttgttaggaagaccacgttcgtctggaacttgtccaccgtctgatcgttacgtaacttagcaagctggtcctgatattgtcgtaaactaagcgggtggttatgttgtctgacaatttgttcgccacgataccacacagccatcactaggaaaattagtaaagcaagtccgaccgctacgtagccgccgtgccagaacttggctgcgctggcaatcaggaaaattacttcgatggtcgcgaagaaaccggtcagtagtcccgcaccgattaatggtaagcgcttttgccgtaaaaacgcgtagatcaaagtggtcgtcatcagcattgtcagtgtgatggcactaacccgtatgcagcttccattctttcactagtttgaaagaaaatcaccagcatactcgtcacgccccacagcccccagttaacgaccggtaaatacatttggcccactgctttaccggggtaagtagtcagtaatcggggaacagtttcagtcgaatcgcttcactaactaacgtaaacgacccactgatcagcgactgtgacgcgataatggccgcgagcgtcgcaaaaatcactgccgccatcgtcaggctagcgggtaacattgcaaaaagggattcacatggccctgaatcgcttggccgggacctaaaatccatgcggcctgaccgaaatagctgagtagtaggcaagctttgacatacggccagctcaaccgaatattcgttttgccgacgtgccccaggtcactgtatagagcctcagcaccggtcgttgccagaaagacgctccctagaatcaaaattcccactttgttcgccgggctgatcaagagtcaaaccacgcataatagggattcagtgcacgtaggatcgtccaatcctcgcaccagattaacgaagccactgactcccaaaaacgtgaaccagcccaacatgatggggccaaataacttgccaatcgtgttcgttccaaaacgttgcagcataaataatagggtgataattccaagtgtaatcagtataatcgtattttggctggcaccaaacagttgaacgtatgctggtacatcgcgtaagccttcgatggcagtcgtaactgtcactgcgggagttagcgccccatccgccagtaacgcagccccaccaatcatggccggaatgactaaccagcgagcacgatgacgcaccaatgcgaataatgaaaagataccgccttcgccacgattatccgcgtttaacgcaatcagaacgtacttaacggtcgtgagcaacgtcattgtccaaaaaactagcgagacggcccccaacataaacttctcatcaacggcacgcatccccccttgaccggtaatgatggccttcatcacgtataacggactggttccaatatcaccatatacaacgcccatcgcgactaacaatcccgccacccgatgcttattgaactgagcctgtttactcattatgcccccatcctttcaccgatattcacgagttacagccaatcgtccctcgttataatgggttcaactagcttacctaatcgtcatcagaaagacaatcataatgcacaataacgttagctcatcactaaatgctccaacaggccctgtaacatttaccggtagccaatttagaaactaaaagcgggtttcaatccagtcattaactgaattgaaacccgctgattatccatactcggtcatcgcaccgaaatagttcaattatgtaaataattaatccccatcgattgactatgattgaaacgtgcgttgtgtccgacgtcgtgttcgatcagctaacccaatactaatctgtaacgcattatcaactccggcgcatcgtctgatcatccaaatgagtgacgcgatctttaagccgttgcttatcaatcgttcgtatctgctccaacaacacaaccgaatttttttcaatccccgtatgggcagcgttgatgttaacatgtgttggcatcttcgcttttgaaccttagcagtgattgccgcgacaatcactgtgggactgtaatggttaccgacattattttgcacgattagtactggacgcatgcctccttgttcggagcctacgactggtgataaatctgcataaaagatgtcaccacgcttaatgtcagctgcggccatcgcctcatctccctttattcgatacccaatgtatctgatagtaccccaatataaccatcttgctactcataatagcatgaaccattcacttttagcaaccgtttaccaatttaatccaaagaactaatcgctaagcaccgttaaaactaatacttcagaccgattaattaagactgcccaatgatgcatttcatcaatgtttaaaaataaacgaacttataattagatgccgataaatcactcgaatcactgaaataaacttaacagccctcatcaataaaataggagactctaaaaaaatgagtgccagaatttctctggcactcattttattggcttaatctcaataaccaaccatgtaaccatagcctgtacgagacaatcttcgcaaacctatcgtctgataaaacttaatctatataaactctcggcactcgtggtgctaacccacaagcaatctcataatgaattgtcccacaatagtcagcaatatcttgcaacgaaatggtacgagcaccgtccgtgccaaccaaagttaccttagctccaaccggtacttcatgtggcagacgaaccatcagctggtccatgcagacccgtccgacgatttcgcaaaactcaccatcaacaagtacatggaagccttgtaatcggcgttcatagccgtccgcatacccaatcggcaccagtgccaatccattcatcctgtgcggccgtatacgtggcaccatagctgaccgatttgccccgagccaagcgtttaacaaatgtcaagcgtgccgttagcgacaacgcgggttgcaaggggtatggtgcgctgagttcgcgaccagaaggatttagaccatagagtgcaaccccaaagcgcaccatgttgccattgcaagcttgatgccagagactggtggccgaattggacacgtggacatagcgtggtagctcatccaccactgcaatcaagtgtttccaattatttaattgatgagtaaaatacgtatcatctgcctggtcagccgttgcaaaatgcgtaaaaatcccttcaaagtcaaatggtgactgcggttgacgcaaagtcgtaaccgccgttgccaattcttcgggcgtctgaaacccgattcgtcccatacccgtatctaatgcaagatgaacgtgaagtggtgtcgtcacttggttagccgctaaaattgctgcggccgtagtcagccaatcttgcgttccaacagctagtgaaatatccttttcagctaccagcagcggggcgtattccggttccgtaattccaagtactaggatgggttccgcaaagccagcggcccgcaacgctaatgcctcatccaggattgcaacacaaaagccggtcgccccggcttctttggcagcctgagcaacttggataattccatgtccataaccattcgctttaacgactgcccataactcggtcaactcatccttttgcgccatttcattactaatatttgtcttaattgcacgcaagtcgactgtgacttgtgtgtggcggtgctccccaattacaaccatcacaaattgcctctttccaatataacttgtgtcattactaacgtatccgtgtgtgaaattgaaatccacgctggaccatcaaacgggtggcgcgtaacttccggtttaccctgggcgttgtctaaaatttcgatatcttgaaatcccaaactgccgcaccaattcccgtgccatatgccttactatatgcttccttagctgaaaaacgccccgccataaactcgatctggcgtttaaccgggtaacgtgaaaacaccgccaactcagccggtgttaagatcttttcaggcaatctcagtcccttcgctagaatcgcttcaatccgactaagctcagttaaatcaatgccggtaccataaatcacgctgtgaccccctctatctcattattatcacgtcaacttaggctgatgtttccaatttaccacagctaccgccgcgataaaagggcccatacacgcaatcttttcatgtcagcatgaattattgttaaaacgttccaaacgcgtcaagtcaaagtcggccagctgaggccgctggaaaaaaagtcgagtgagcgtaaatatgtttggttagtgcgtcctaacaccgacctccaggcatttcggccaattgctggaacgcggtggacacagatttaagccgaaggaccacgtcttaaatactggtcttccactaaccaagcaaaggacgcttgctaagtggaatttcaccgctgagcattggccgaaacgccttccagtcgggacagtgttcgaatggcggacatgtgtgtacccaacttttagtaaattcgtcattgtttttcataaaccataattttgtcaatcaactgtcagacagaaaatgacattgtgatagctcactattcccgaatcactataataatcgaacgtctcaacaaggcggttaatgtcaccctaacgtttcgtttaaggttccggtgtcaaaatagtcagcgaccaattgtgccgagttaagtggccgttcatctgccattcgagcgggttcctgaaacgtgttcggtaccgctaaagcctgtgcttgctacgccaacggactaatgccaaagccgtattaatccgttggctaggcaatgctcggcttcaacccgtggcccctcacaggcttgagactggaggggctggggtgacaatgctcagtagccaagttattcttaggcggaagtgggttgcttccggcttagaataagactcgtatttgagatgacgcgggttgggcgttagctcaaatcgacgtcggctacgttccagcaattggcacccagccccggaggtcgacataggacgcacaagtgctgacgaacaacaaaccaattaaattggaacgttttaacaataattcatacgaacatctgccgactatttgtattctaacattgtagggcataaaaaagccgagcatgcgctcggcttttgtgcaaagttaatttaattcaacttaatttgtgcgttgactttaatcattggtgcggatcgtatagctccgcttgctgctttgcttgcgaccttcatcatggttgcggttgctgctccggttatcatcgcgactgcgacctttataaccattgctcttccgatcaccacggccaccgttacgatcacggtcgcgattgcgaccattggtgagaataaccgccacgaccattgccatgactgttattgcggttgcgattaccgccacgatatccgccacgccggttgttaccgccgccacctttgtgacgaggtaatgggcgttctggcgtaatcttaacgggtacggctgaggcgtcgtccttggttaagtcatttaacaaggcagcaactagatcagtagcatcgtatttttgtaataattcagcagcttgatcagcatacttttcagtcgaagtcttagcaactaacgaatcaacattcgcttctgcagcagctaattggccagcaaaagcttcagattcagttggtggcttcaatggtaacatccgcttcttggtcaacttttcgatgacccgcaaatattccatttcgtttggtgttacaaaagttaatgaaacacccttgtgtccggcacggccagtacggccaatccggtgaacataactgtccggatcctgtggaatatcgtaattgtaaacgtgggtcagccaccagaaacatcaagtccccgagcagccacatcggttgcaaccagaatatccaatttaccagccttgaattgacgcatgatttgcgtccgacgttgttggctcaaatcaccatgaatcccagcggcattataaccacgtgcttcgagaccctttgataattcgtcaactcgacgtttcgttcgaccaaacacgattgtgagttcaggtgcctgaacatcaaacaaccgggtcataatatcgaacttttcaaattctttggctttgacgtaatattgatcgaccgtatcagcagtcatttcttttgatttgatcttaacgtgatgcggttccttcatgaactgcacaccaatgcgtttgatttcaggtggcatcgttgcggagaacaacatagtttggcgttcatccggcacttgtttgataattgattcgatatcttccaagaaacccatgtttaacatttcgtcagcttcatcaagaactaacatcttgacgtggtctcaaacttgaccgtgccccggcgaatgtggtcaagcaaccggccaggagttccgacgattacttgtgggttttgcttcagatttctgatttggcgccgaatatcagcaccaccgtaaacgacttggactttcgcccgttcgtctttacctaagcggaagatttcttcctgagtttggattgctaattcacgcgttggtgaaacaactaatgcttgaatgttatggttgtcaaaatccaagcgttgtaagattggtaatgcaaacgcggcggtcttcccagtaccggtttgtgcttgaccaatcacatctttgccttctagaaccattggaatggtttcggcttgaatcggggtcgcttcttcgtatccggcccgattaactgctttaagtaggctatcggataagcctagttctgtaaacttcaaatatgtttcctcctaaggatgacaccatgggattactgccagctaggaaaaatccgtttcccgtaagacgctgtcatgtaagccaacggtctgactttcatatggtacaactgaattatcatacaccggttattctaaataagcaagcaaagcccctagcaataccggaagggaaacaacattatcagtctaatgttagcgtcaccattacccagtcattgcgaggggcccgcttaatcgaatcacttaaattttatttttcaggagcagcttccagcgccgtcagaaccttttcaaggtgaatcccgtgactccccttcaataagacctgatcatccgcactaaccgtcgccgttaagtcggcaatcaattggggttgttgatccgtttgataatagtggactgcaccggctgggtacttttcttgtagcacttctgccaacgctcgcatatgttcaccattcaaatagacgctggcaatcgtggctggatccaattcactggctaaactcatgtgtagtgcatccgactggtcacccaactcaagcatatcaccgagtacagcgattcgctgacccttagtagtaggtaccgccgcaaaagcggctaggacccgtcgagctgccgttggattagagttataaacatcacttaagatggcttctccacggtaaccagttaaccattctgtccggttctccgtcggcacaaaactggcgattgcttgttgcgcagcggctggtcgaatgtgaaaagtatcagctaccaagagcgccgccaatgcattattgacattgtacgcacccatcagcggaattgtgtacgtgttgtccggccacagactcgtcttaaattgcgtttgagcccgactagtcgtgatatcactgctcgctaaggtgttcgtatcatccaacccaaacgtccgttgatgctgactgacttccttagcacgttcttgtagcagtggttcatcaccattaaaaatgaacgtgccatcttcttttaagccgtggacaatttccattttggcatcggcaattcgatcccgtgtaccaaagaactcaatgtgggcttcccccaatcatggtaatcaccgcaacgtccggctgaacgagacggctcaagaaatccaactcgccaaaatggtccatccccatttcaacgacgaccacttctgtattcggttccatactgagtaacgtcactggcacaccaatctgattgttaaagttggcgtgcgtctttgtcacgttaaactgagtgcccaaaacactcgcaatcatatccttcgtcgttgttttaccattactacccgtaacagccacgactttcggattaattttttgtaaatagtattgccccagctgctgtagtgccgtcaatgtatcagcaaccataatgacaggtaagtcttctggaacgtcgtcggcatggtcgctggcccataaggtagcaactgccccgtgctcgattgcactttgaatatattgatgaccatcattagcgcccatcagcggaataaatagatccccgcttggagctttcggctatcaaacgccacacccgttacattaacaatcgggccacgcctgttcggcattgaccgcttgaacggccttagcaatttcggcaacttgcatcttcatatcgattaaactctccattcatggcgaccacttgtcggtcagccaagttctgactaaggttccactttctcgaatcgtagcccaattcaagctacgcgcataaaaattataccactttgaccccagggactctatggctagaccaatttagcccctaaatcccgccccaaacgacttaaaaacgcccgctgaatgatcagccaagcgttaagatgataatactataaatgttcttcgaacgcagcctggtcccgcacttgcaagtcccacacgcctgaattcaagttaaaagtaagggtcgcgacatggtgggttcgccgattctctccaccacgagcgggatcaaaaacttcgatttcattgcctgtcgtctccgtgtgcaccggcaccaataattggcgttgccgaaccattgactgatcaaagtaaaacatgaacaaaccatctggcatcaattgaacgagttgcttgagaatcgcttcaggtactcgtggaacactcagtgaacgcataaacatacgccggccacggtaagctgccaaagtgtgccgcacaatggcagcacttaaaatatggctaaatgcggaaatataatagaagtacactttgataccaccattgcgttgttccaagaaaacgtagtggttgcgcagtttgtaattaaacggtgatcgaattggacgatccatatgtccgagatacaatagctcggcaatctcagtcgcggttagaaaatccaaatcgccaacttcatcataatcaagccacttaacgggtaacgcgtgactctgtaacaaatatcgccgaatttcattttcatcattaatgacgttcagacccgtgtgagcatttaccgcatgctcgttatcatcaacaccgactaacgagaccaagttagctggcaagcgtttgataccatgcacaaagtcgcttctggtcgatcccgtaagcaaagacaaggttatccagtttttccaaattggcgtaaatatatttgcgttgcaaccgtctcactctttcaactttctatttgttttcattataatccgttattaacctaaacgcatttttttattacatgtttttaaacgagtgatgcgatcagccatcggtgggtgggtatcgaataagtgcgtccatgatttcttcgccttaaacggatcagaaatatagagggccgcgctactaggatccgccgcttgcatgggttggctgtcatcgattttttcaagggcactgattaagcccaacggattacgagtcagttccacactgccggcatccgctaagtattcgcgattacgagatagcgccatctgcactaaactagctgctagcggcgctaaaataatgacaacaatcgctaggatcattagtaagacctgggcaccgttgccgtcacgatcattatcccgactgcgccggccaccgcccccaccaaaaggcgttcataccccaattgactaacaaactgatggccgctgtcagagccaaggcaatggtctgtaaccgaatatcatagttacgcacatgactcatctcgtgaccaatgacgccttccatctcttcacgcgttaatcgtgcctgaataccagttgtcactgcaactgccgcatgctcagggtcatttcctgtcgcaaacgcattggggctctcatcatcaataataaagacacgtggcatcggtactttagcaaccaacgccatgtcttccacaatgtgccagagctctggatcatcgtcagcttgatgcagctcacgtccatgattcatgctcatgacaatgtcggtcgactgactaatcattaataccatataaaataccgctgcaatcaaggctactagtaaccccgcaatcgcactattaaaaacacgtagccaactgctaaaccaatcactgcaagtaatatgacaaaagcggccatcacgtataacgtgtgccgcttgttgcgggcaatttgctcaaataacatgggcataacctctaatcttcaaatgaaaccgtgggtgctgctttttctgcttcaggaacagttaagaattcaacgttcttgaagtgatgaatgccagcaataatatttgacgggaattgttgtaacttcatgttatagctggcagcgctagagttgaacagttgccgtgaataagcaatcttgttttctgtattggtcaactcttccatcagcttaccgaattcttgattagccttcaaatcagggtagctttcagccaacgcaaaaatgctcttcaacgaatttgtcaattgatcagaaactgccatagcctgttggtgatcaccgctcggcacttgcgttaattgattccgtaatgaaatcacttccgctaaggtactcttttcatgtttcgcgtaacctttgactgtattgaccagattaggaatcaaatcagtccgccgttttagctgaacatcgatttggctccacgcttcctgcgtatacatccgtgacttaactaaaccgttataaattaccacgtaaattgcgatcaaaaccaatacgaccgcaacgataattaaagctatcatcaatagaccccctctaaattatgtcttatctgagacatgtgaccttaagttatattgtaccgtgaaattccgttagaagatatcgatacccctagaatgtaataattgttaatatttgttattaaaatgacttgtaaaggccttctgaacctgagttggcgccgacttaaacgaccattgctgttcgtacttaccgcgaatcattaagcgacccgccccggtcttatcacaggtaattagggtaatcagcttctgaccaggaacatcatcaattacttggacatcagttgctttaatgaatgttcgctgactcgtcttatacgcataaatctttttggcatcactcacataaatcatttggccaaccttgctcttatagtacaacggactgaatagtgcgccatgcttgatcatatggtgaccagccaacgcgtagttaccccgccccatcttctgattagctttcatcgtgccagccgccaatgctaacgtttcattgctgacaccattaccgattggcggtacaaatcaacggacggaatcgcaatcgagccaatcacgttgattgcattcttattcatgcgggccttggcaacggtctgaaagtcaagtgacttgacctttgagaagttaaaatcgctcttcttcttcgtattctgcttaaccgtcttagccgtaacggtcggcgagtatgaactcactaaccagctcttgatctgttcattgaaaattaatgccaatgatactagcaccagcaggacaaaaacgccccgacctaaccactttaacccgggatgttgcttggacttcattaatcccgcctcctaatttgtttacgccctttatcaaaggttctacggtaaatataccttaattagttcgctaataataaagccccgaattcgtttagttcgttagaattatctatagcttatcataatcattatatttgcgtccgtaatcagattcttgttatgctaattgtatcaaaaacagaaagcgggttggacctatggaaacgatggtaaaaaacgatctcaatcaactaatgcaacaacgtgaggatggcccatacattgcaatttacctcaacacggccgttgtgctcaacgacctcaatcgccgccgcttacaattcaaacaattagttaatgaagctgaaacccagatggcccaccactttccgaaaaccgaatttgcgccatacgcgacgcaactagagcaattaattaatgacaacgccttctggttacagcacactggccctcagacaggcatcatcactaacagtcgtgacctacacattttcgacttacaatatcccactgacaaccatgtcagcgtcaatagcatgccagctattcgcccagtactagccgaccgcacagcatcaattcgacttcgacttgctagcactcaatgaagatagcatggcgctctacgcccaacgtgatggcagtttcgtcgaacttgatttgccagctgaggcccccgcaccctgacagaagcattgggcactgaaaaacgtggcggtgacctgaatttcaacgccagccccgttcacggtgccaactatcatggtcataatgcgaaggccgaagaacgcgatattgaccaacgaaattattaccaacaagtggcgcagtacgttcaggcccattcacaaaagacgcgacggccattgatcttaatgggactaccacataaccaggcagtcttccgtgccgtcaacaagaatccgtacttgtcacaacacctcatgatcaataagtcaccgaaaaacttaacggtgggcgcaatgcaaacagccacagaacccgttcagacgatgtggcatacccaattagccgacattttactagaacgttatgatcaggctaagtcccgccagttagcattggccgatccttttgacatgatcaagccagcactaagtgggcggatcgacaccttgattgtcgccgcagacgcgaatgttgccggctccttaccagcggccgatgttcaattaaatgatccaattgctgctcctgataatttaattgacgacctggtcgatgtcgtgattgccatgaacgggcaaatccgaatcatccccgcagaccggatgcccgtagaaaccgctgctctcgcgattatgcgctactaatcatatcgtaagtgagacaaagccgcaccagttcattactcgaactggtgcggctttgtttgtgagcgtcgatgatttgcacatacaaaaagacgcccccgccgaagccggaacgccgtttaattgtctgcttatttgagaccgtatttcttgttgaaacgatcgaccgcaccatcggccttggtaaacttttgcttaccagtgtagaatggatgtgaatctgacgtaatttcaacacacggatcaatgggtaagtattaccatcttcccattcaacagtttctgctgaagttgctgttgaaccagagatgaacttaaaaccagtagttgagtcttggaacacaactaaatggtaatctggatgaattcctttttgcattgtatttcgctcctttgccctgaatcatttgctgaaacagagattatcatagttttaaccaacgataaacatgttatcacgaatcacagcttcccgtcaacctacaaagtagcccgcccgccagtattaacgacgcgaccgccgggttgattgaccagtgaactttaagctagctaaatcacgaacaaactcagtgttggtcttcgtgtgttttaaaaattgtaaaagctgttcggtatactctaacgcgttgccagtcattgatcgacgaatctgccagactggctccaaattcttacgactaaccaacaattcctctttacgcgtactggattgcttcaagtctagcgccgggaagacccgccgctcagctaactcgcgggatagctgcaattctgagttgccagttcctttgaattcttcataaatcatgtcgtccatccggctacccgtatcgactaacgcggtgcctaaaatcgttaggctaccaccttcctcgatattgcgcgcggaaccgaagaatcgcttgggcttgtaaaacgccgtgggatcgaccccaccagacaacgtccgcccgctagacgggatgaccaaattatatgcccgcgtaagccgggtaatcgaatccaataagataatcacatcctgtttgtcttcaactaggcgccgcgcacgttcaagcaccaattccgcaacacgcacgtgattttgtggttgttgatcaaaagtagaactcaccacttctcccttgattgaccgctctaaatcagtcacttcttcgggccgttcatcaatcagtaacataatcagcttagcgtctggataattggcgacgatgccatttgcaatattctttttaacagcgtcgtcttaccggctttaggaggtgcgacaattaagccccgttgaccgaagccaatcgggacaaaagtatcaatcaaacgggtcgctaaaacggcggccgttgtcgataacttaatttgtttttgtggataaagtggtgttaacgctggaaaatggggccgttgcttggcctcattaggatccttaccgttaaccgtccctacccgcattaaaccgtaataccgttcgttaggtcgcggtggccgggcttgaccagccacatagtctccgttacgaagaccaaagcgatgaatctgcgactgagaaatataaatatcttctgcgaaggcccataattaattggccgcaaaaagccatagccctcttggctaataatttccaagacgccttccatttgtacaaagccccgctttttatcccgctcacggagaacggctaatgagagttcctttttattcatttgcgaataataagaaattttatactcacacgagcatagttataaatttcttttaacgttttctgctcgagatcgtgcattgttaaaattttttccataaccactgttctttcttagctgtacatcgttagttttcgggaacttcttcgtcggctgcaatttccacatccgcaccaagtgtatgcaatttatcgatgacccgatcatagccacgtagaatattgtcagcgcgactaatttccgtaacgccactagccgcgagaccagcaatcattagtgccgccccagaccgaatctcaccggcctcgacatgtgcaccttgtaagtgggaagaatgacccacgacaatcaagttatcttgaacgcgaatgtccgcccccatcttacgtaactgttcaacgtgttgcgtgcgttgcggataaatcgtatcaatcaccacgctactaccgttagcacgcaataataatggggtgattggttgttgcaaatcagtggcaaagcctgggtaagtcattgttttaacccgaattggggtccaaatcattggaccgtgggacgtaaatactatcttcattaatctgtaaatcgacacccatttcgactagttttgccgtgaatgactccatatgttcagggatcacattctttagcaaaataccgtccccaatcgaagcagccagggatagatacgttcccgtctcaatccgatcaggaataatcgtatgggttgcccgcgaatgcagtgccggaacgccttcgattcgaattacgtcggtaccagcaccccgaattttagcgcccatattattcaaaaaagtcgctaaatcaatgatttcaggctctttagccgcattttcaatcgtggtcgtaccatgagctttgacggcagccaaaataatgttgatcgtcgccccaacggaaaccacgtctaaaaagatgcgcgctccgtgaaggccctctgtgcccgttgagataaagacagagtcattctcttcaacgacgttagcgccgagcgccttaaaacccttgatatgctgatcaattggccgcggaccaatattatcaccaccagggaaagtcaccgttgcacggttaaaacgaccgagtaaggccccataaagtagtaagaagcccgcaagcttttaatggcatgacttggtaattcagattcttcaatatttgttggatcaattgttagaacatcgttttcaaaagtggaatggacgttcatcgactctaagatgagccgtaagttgtgaacgtctaagatgtgcggaaccgtatcgaattggaccggagtgtctgcaagaatcgcagcaggaatcagtgcgacggtactattttttgcgccaccgatcgttaattccccagaaagtcgttttccgccatggattatcatttttttcataacataactttcctcgctaaataagtgtcacactgtatcatacaatcattaaccataataaagaatgtctgtcaaaaatacaaccaatatcaggaaactgtaatctttttacgcaataaaatcaatcaactcgactaattcaaacgctttcatgaatgatttggtaagataattaagctaaatctgcacaattcaaggtgccgtcaaagtcgccgatatcacacagtttattctgatattaacagttaacatggtcacatgattattgtcactattcctcactaattttgctgctgtcatactatgtaccccatacgatgattgggagcgcgatgatgccgaataataattcaattaaacgttccactttaatcatgccccgcccagaacgactattagcacaatgcccgatagaaaaatagaaaagtgctaatgcgcgtgataaatttcactggcattagcactctctggactgaattgaacctgatggactatcagtattcatgactaatcacttccttatttaattaataaccttccgttacccgttaatcgcaagtagctgttccatatgttggggtttcatattaagttcacgcaactgcaataacgtctgctttaagtttttcatactcggcttccgtgtataaacggctctcaaagccaatctgataagcttcggcaattgtaaccaaatcgcgtcgtaaccggcgtcgaatttcgttcggtgtcaacattggcatcacctccatttattattcaccataataccatataatgcgccaatcaacggtccatgatacgatttgataatctttgataattgataataatcgcaattgacccccgctacatcagcctttcaactcgctgtcagctaatgaaaattgcatgagatttattatgatgataatcagttgataaccaaattaataaaatctttaatcccccttttgataagacctagaaaattcccactgacatcctcaaagatgtcattctaaccaaattatcataaaaggggctacgttccaacctgaatcacataaaaacacacgctcccctggcactaatcgccacaccaattgcgaccagccaccactgaacaacgggggatttgattgcgtcagtttatttaactacttaaaatgcggcagcccgcacacaaactggttgtgttggctgccgcatttttacggtggtgaccatgattcttacctgtccaggaactcagagtagcttcctcacagtttcgccactatggctgaactaaattttgacagggtttcatgacgttaatcgcttacaattacatcgtttaatctcgctggagatcctcatctttgacggtctgcaaataacgataaacactcggatcagagactttgagcactttggcggcttcactaactgaatccttcaataggaagtaaccttggtggtataagctacgaacgatttctaatttttcattttgctttaaatattcaacagaaacgccatacttagcacagacagcctgggtcacttcccgagctaaatcagtgatagaagtggttagatgttccggcgcgaccggcgtgtcatgggccttctcgttagctggtgttcctttgagttgatttaatcgttggtgagttcaaatgtttgtaactcgccattaccttcaatacttgttccgcagatcgtctaggacactatcatccgtattaatacaaatcatcccgacgatttcaccatctaatcgcaaaaaataagttgatgatcgtagtgagtgctttccttgcgaaacacccttgtagttggctagataatcacgcttttcagctttaccggccttcatcgttcgcaacgctaagtcagttgcgggatcgccaacttgtcgatgtgatatgtgggaattacgaattgccacaacggagtggtttaaatccaacaagtcgttcaggacaacttcactactggggcctaagatatctgctaaaaaatcaacaaacggaataaactcgcgcacgtattcttgctcagctgttaatggtttttgcataacggcactcacctcactatttttttacaacgttatgacttaatattattttatcacactgataaaatgttaatacacagtgtaacgatataaacatctaattaaaaagatgataccgcctttagtcagctcatcatctttctgcgacatttttatgcatgaacttgtgaattagtcgatcgtccaaaaatcttttccttcatccgaataccggttggcgtcgccgctaagccacccagtccagtttcccgaagtgcctttggcaagcccttaccgactttatccatcgctgcaatgacttcatccgctggaatcttgttcgtgcagccagccaaagccatgtcagccgcaatcaacgcattaccgaccccaatcgcattccgtttaacacacggtagttcaactaacccagcaacgggatcacacactaatcccatcaagttactgattgccatcgccaaagcctcagcactttgttcaggcgtcccaccagcaacttcaaccgcggccgcagcgcccatcgcagaagcgctaccaacttcagcttggcaaccgccagtcgcaccagcaatcccagcacattattagctatgaccatcccaaaagcgccagcggtaaatagaaattggatcatctggtcacggttgaggttcattcggtccttcagcgtgaaaatcacaccaggtagtgtccccgtcgatccagccgttggtgtcgcacaaacgactcccatcgaagcattaacttcattggttgagattgcgttctgaacagcttgcatcatcgtatcgccggataaagtgtgccctttttgacgatactttttcaagagaacagcttcaccaccagttaaaccagttgttgaatagaccccgtcgcccgcagcccctttattaacagctgcttccatgacgtctagattccggcccatcgtgtgccagatttcttcacgactcgtttgcgatgtttccatctcttgttcaatcattaattcgtagatcggcttcttggtctccttggccgctgttaccagttccgctacgctcatgtacatcataactgacctccctgattataagtaaaactaaatttgcgtgtccctgcgctaattttttgatttcatcctgtttgaggcggcgatccaaatcatattcatataaattgccccgagccgtcttgtactgctgctggtcgtttactttagtcagatcagccaactgtttggtcacgtgctgatggtcattctcaccaccttgaactaacaagataggaagtggccctttgggtttaacatcaaaaccatccatcttgatttcacgaatttcgatggttccacccccgattgaacatccagcgaccgtcacttgcttatcatcattttttaagtcaatgatggcagtgttcgggtggttgattgggctatcaccaggctcttcgataaaggtaatatttatcccctgatctcgggccaaaccaatggcatatggaacccggctatcatcaggatcaaaaccaagaatgccactgataatcgcatagtccgttccgtggcccttgtgggtttgcgcaaatgattcatagtaaatgaatgacaatatctgtcggtttctcctgaaaaatgctattcgctgctcgaccaatcgcacacgcccccgcagtatgggaactggaaggtccaatcataatcgggccaataatatcaaaaacactcttgtaattcaccgtcattttagtcatcctcctatttgaatcatcacgttaaattaagctttggcacgggcaactagcgcttctttgcgcattcatcgtcagtacatcgtttcgaaactttatgaatcttgaagttacggtacaagcaagcaccacagttgtactgatgagaaaacataaagccgttgcatcaaagctttcatttctgaattaactccgccgttgtgattaatccagcctccagtatggtcattcgattcgcgaccctcacgaaccccaacaccgtcatgcgaatctcgtcaatagcactagcaacgagatttatgacaaaaattggcttcaataatattaaccaatgtgaattcatctcgtattttagtcagattactaaataaacaatttgatgatattgaacaggataccactaactgcgattaatccaattaccacaacaaagacattgctgtgtttgccggcatattgctgtaacttaggacttttatgaatggcatacattggcatcaagaacaagataaacgcaatgattggtccaatgatggtttcaatcattcccataatggaaggattgacccaggcaactatccaggcacttagtagcagaacaagatcaacaattgtcgaaacagttcgacttgaaagcgtcttgttagatttttcttccatcttacgaataatcccacgtaagccttcactcgttcctagataatgtcctaaaaggacttagcaattgcaataaaggcaattacgggagaaacatatttaataattggattattgaaagcagtcgcaacgtaatcaaggattgaaacattttcatttttagcttcaaggatttgatctggagtcaaacgccaatgtacaactaataacaaagaacattgcgacaatgaccatcaacgtttcggccgacaatagaattgtcgaaatctttttatcgactttgtccttaccttctccactatattctttacgttcggcaacggaaaatgaagagataatcggagaatggttaaacgaaaagatcataacaggaataagtaaccacaagtttcctaaagtgccaaccaaatgtccccagatacggaactggaaaatgttgagaggattgcgccgttccaatgtggaataagataaaaggaaaacagaacgattacaataataaatggaaaggccaggccactcataactttggtaatcaaagaggtaccaaagcgagcaattccaatgaggatcccaacaagcactagcgacaacagccaacgaggtggtgtttgcatgtgcatttggtcggtaataaatttcgatacagtattcgtaatagaaacagaataaactaataagattggactaaatggagaagaaataaataatggtaaaaagcaatccaatcttaaagccaaaatgttgttcaacaacatcagtaatgtcatcaccatcatttttagccgacaagacaaacctactcaggcccctgtgagcaaaaatgtggttggcaaagccaaaataagtatcatgatgataccaagaataccgccgtgccaactccaatcggtaagaatagcacgccggccccaatcgccgttccgaacaaactcagcatccaaaaagtatcatttttctccaacccttaaatatatttgtcatttttaaatctcctttttataacgttgttctggtcacaccagagaatgtgctaacataacctgcatgaataaccctcccattagatttaacgtctcgactcgttgtaaaacgccactttgtgataaacatcactttagttccgtgaaaaccttttcttcatgataaaatattatcacggtgacaattaccgttcatgtgattctctcgattataaaaattaagtatttttaacaccaaattaaaaaggactgagattatcataacagtcctagcctgtatccatctcaatcctagtgatattaagtttaacattcaaatgaattatttgaataataatttattctcataataattttattttatctctgtcataccatgcatgtaaggttggagcaccttaggaatcttaaccgtgccatcggcttgttgataattttccaaaatcgcagctaccgtccggccaacagcaagtccagaaccattcaacgtgtggacgtaatcgaccgtcccatcagctttccggtaacgaatcatcgcccgccgtgcttggaagtccaagcagttagagcatgaactgatttcccgataaacgccttgttctggcatccatacttccacatcataggtcttggctgatgagaaaccagtatccccgttgaaagcttaataacatggtatgcaagccctaattcgcgcaacacttcttcggcattatccgttaatttttcgagctcatcgtatgaattctcaggtttacagtacttgaccatctcgactttgtgaaattggtgcatacgaatcaagccccgggtatcacgccccgcactcccagcttcggagcgataacaaggcgtcatcgccgtgaagtacgttggcaattgatcttcagataagatttcattcgcatagtaattggtcagcggtacttcagccgtcgggatcaacgtcattcctgaagattcaaccgtgtagacgtcttctttgaacttcggaaattgcccagttccatacattgtctgcgcgttcaccaagtatggcggaataatttcatggtacccttgcttttgtgtgtgcagatctagcataaagctgtaaaccgcccgttctaagagtgcacccgcatccttataataaacaaagcgcgcgcccgcgacttttgctgcccggtcaaaatccaagattcctaagctttcgcccaattccccagtgcgccttaggtttaaaatcaaacgttggaatatcgccgtgcttacgcatctcaacattgctatcttcgtcaggaccgaccggtacatcatcggcggtaaattcgggaagcgaatcactaagtaatgaagccgatcgtttacttccgtttgggccgcttccgtactcttaatatcaccattcagctgtttgacttgttgaatgagggcttggcccgcttccgattgcggatcactttgcccaatttgttccgtcaactggtttttctgtttcttcaatccttcaaccttggtaattgcatcccggttttgttggtctaactgtaagtattcatcaacctcagccggatcaaccttccgagtctggagcttagtcttaacaagttctgggttattacgaacaaactttggatttaacatacgaaaagcctccttaaaattaaaacgtcccatagtcttcacctaaaagactatgggacgttttttatcaacgtgggtaccacccaatttactgctctacgagtatatcgtctcaccgcgacctcttaaaaatgaagtcaaacgctaaatggcggattcatcagtccaatcaaccaactttcagcaaccgttggctttctaaataaccagattaactactaacccattatgtttgcgctttcaatttacacttataatctagacctcccgccatttattgtcaatagtttttattatcattttatttttctattatcaagagaaccatttattgttaccatgtattttcgcaacaccagttgtcactgtgaatatcggtgacctaatcaagcccgtggccgcccaacaaaaaaagcacaccaacaattcgctggcgtgctttattcttaattctaccgtactaaatttatgccttcactttaccagtctggttagcggcatcgatgaatgctttgaataacccttctggacggttaggccgtgataagaattctggatgatattgtgaggccacgaagaagcgcttctttggtaattcaatcacttcgacgagccggttgtcaggcgaagttccggagaagaccatgcccttagcagccattgcttcacgatacttattattgaattcataacggtggcgatgacgttccatcacaacttcttcattgtggtaggctttagccgccacagttcccggcttcagcttgcaagggtaagcgcctaaacgttgcgttccacccatgtcttcaacgtcttcttggtcggccatcaaatcaataatattgtccggcgtcttcggatcgatttcagcagagttagcatccttcaatccaagtacgttacgtgcaaattcgacactggccatttgcattcccaagcagatgcctaagaatggcacgtcgttttcacgggcatacttgatagccgtaatcttaccttcaattccccgatcaccaaagccaccaggaactaagattccgtcagcatcgccgagtagttcttcgacattttctgggcgtaacatcttcagcagaaatcttcttcaaatcaatgtcggcatcatccgtatagccagcatgcttcaatgcttccgtcactgagatataagcatcctgtaaagcgacgtatttcccgactagcgcaatcttgatggtccgtgataagttctggacatgatgttctaagtcaatccattcactcatgtcggccttaggtgcctgtacatcaaaatggtcaaggacaatttggtccatgttttgtttctgaacattcaacggaattgaataaatcgtcttaacgtctaaggattcaatgactgcttctggttccacgtcacagaaggacgcaatcttattccgcatttcccgcgtaattggttgttcagtccggacaactaacatgttcggctgaatcccataactccgcaattccttaacagaatgttgcgttggcttcgtcttcatttcaccagctgcccgtaaatatgggatcaacgtggtatggatgtagaagacaattgtcggaacctaaatcgctcttcatttgccgtagcgcttcaataaatggcaaggattcgatatcaccgaccgttccaccgatttcagtaatcacgatatcggaatccgtcgtcgtacccgcacgcatgattttttccttgatagcgttcgtgatatgcggaatcacttgcaccgtggcgcctaaataatcgccccgccgttccttttgcagaacttctgaataaatcttaccggtggtaacatttgaatatttattaaggttaatgtcgataaaccgttcataatgtccaaggtctaagtcagtttcggtcccatcatcggtcacgaagacttcaccgtgttgataaggactcatcgtaccaggatcaacgttgatatagggatcaaacttttgaatcgtgacctttaagccccggttcttcaataaacgccctagcgaagcagcgacgatacctttaccaatggatgacacaacgccaccagttacaaaaatatatatttggtcatgtgataactccttaaagatttatttcgtggggtggtataaaaaagaaagctccctatttcagcagaaatagggagctaatacgatcgtttgtctcaggtatttctaccagagagcccaaataagataatacaaggagattcccttttcgtcaaggaaaaatcttgaaaagcttatttcgattcgtcgtcttcgtcatcgtagtcgtcatcatcatcgtcatcatttaactctgataattgaccctcgataccgtctggcaacgtttcatcagcaacatcgtcgtctgtgtcatcaacacccgcaagttcatcgtacttgctgcttgctgaatcatcagtatcgtcgtcctgatcatcatcgtcatcgtagttatcgtcatcttcgggatcatcgtcatcgtaatcgatcacgtcgtcatcatccccggcatcggccaagaaggcgttaaccttcttacgcttcttgcgctttggccgatcctcatcttcgtcatcgtccgtatgaataacggcttcgtcaatggattcaaatgggtaccatgcacgcaggccccacatattgtcaccgagcgaaatgaaactaccatcgatattaagatcggtataaaattgtgataaacgctcccgaatttcttcgtcgcttttacctaaatatgattgcacagcgttggtcaagtcggcaaaagccatcacatcaccatgttgtgataagatcgcgtgagcaacctcgattaaagataattcggacttttttgtccatcaaattgttttagttccaaactggtgcacgtcctttccacagtttatagtacataataccaaattaggccgtgaattgcaatcgcaacttgtagttaccaagtagctgctcacccgcgtataaatcgtaatcaacgttcacctcacctgaaaatggccgttcacgtagccgtactcgtaacatcggcgtcaccgtttcaacaggtagcatccccataggcgtttgataatgagcacgcacccgtttaccattggaaaagtgcaaccgaagtcggttctccgcactccgcgtcaacacgacgtccccattagctgccagcttaatcgtcactggaatcggttctggcgcatcatcgttaacttccttataccgtaaataaaacgcgtcacccatctgaaccaattgaccatcgacatccagtgcatagttcgccgtatcgtcatcttgccgcgccgcgtctctaaatgaatcgccactggcacaccagttgttaaatcatccatatttggacctcctaatatttcaaaatcacacgctgaacgcccgtctacgatcaccgtgttaccacactcgctatatccttttcagcgttcacgaccgcgcgactcccatcacgcccatcgtaaaacttcctgtttaattataagccattcatgccaaaataactaaaaataggactaaaagcggtcagcttagatctgctgggaaaagttcgaacccgcgtaaaaactttttgagtcggctgtgttccaacaattgtccccagccccggaggtcgaaataggccgcacgttgctgacgaacaaaaagccaactaacttgcacgtttcattatcctatgatggtatgctacagattaagttgatttgtctaagccaatgcaacagtaccatttttctagtataattagtgatgatacggacaacggtggcggtttcatcatgagacatccctcgtgcccgataatagcggataacggggtggctttcttgacggaatcaacaattgcaactttgagtcaaaaatacgaaccggcagcgatgctggatagttttgcgtatacgaacgccttgctgtggttaacggcggctcgtcagcaaccaatcgttcatttctggcagttacagccaaccgtcattctcggcttattagaccaacgcttgccacggctaactgctggcttagcacatctacacgctgccggttatcaggtcatgctccgtaattcgtgaaggtgggctagccgtagttgctgaccctggtgtactaaacgtctccttatttcttccagcaactcgcgaacgctattcaattacagcggcatatcaattgatggtcgactacgttcaggcagtttggccacaattaaatatcacgactggtgagattacacgctcctattgtcctggtgattatgatttgagtattgccggtcgtaaaattgccggaatgtcgcaacggcgcactgccgaagcgctggtcatcatgctgtatgtcagcgttgatggcgatcagatggcccgtagtcaactcattcagcgtttttaccaagtcagcttagccggtcaccatgacgcgcggtttccagatgttgatccacaagtcatgacgaccgttgctgacgctttggcagcgccgactgacactaccgctacacaagctcgttttatagccatcctagctcaacatgggacggtcgacacaacaagtttgccgttagtcaccgaagaaccctgaatttcaagcacacttaaatcaagcctatcaacaaatgcaacgccgacaacaacgcttgcatcactgaaagaaggaattaatttggcctatcgccagcaactattacccatggagaaagtctttcgtgacccggtccatgattacatttatatccaacatcaagtcattctcgatttgatcaacacctcggaatttcaacgactgcgccgtattaagcaactcggtacgacctcgctgaccttccacggtgcagaacactcccgctttggacattgcctcggtgtttatgagattacacgccgtatttgcgataacttcgaacgtaactacccgacccaggcccctggtgacggtggttgggatgatcacgagcgattggtcgcactatgcgccgccctgttacacgatatcggtcacgggccatactcacacacattcgagcacatctttcacaccgaccatgaagccctaactgttcagattttgacatcaccactgaaaccgaggtcaatcaggtcttacagcaagtctcgcctgacttcccggcccaagttgcggccgtcattcaaaaaacgtacccgaatccccaagtcgtccagatgatttctagtcaaatcgatgccgatcggatggactacctactgcgagattcgtacttcacgggtacgaattacggcaattttgatttgacccgtattttgcgcgttatgaagccgtatcaaggcggcattacatttgcgatggaaggcatgcacgcggtcgaagattacattgtcagtcgcttccagatgtacatgcaagtctatttccatccagtatcacgttccatggaagtcatcctagatcgcctactggaacgggctaacgatctttatcaaagccacgcggtcgacgctgaagccacaccagtgatgttattgccgtttttcaataataactttacgttacacgattatttacggttagacgatggcgtcttaaacacttattttagtccattggcgtgatagccgtgatcaaattctcgctgacctagcaacccgtttcttagaccggcgtcccttaaaatcagcacgagtcgatgcaacgactcaaccgctaattccaacgttacaaaaattaattgaacaagccggctttgatacgcactactacactgacatcaacgacagttacgatctcccttacgacgcctatgatcctaagatgaagaagccgcgtacccagattgaactgcaacaaaaagacggttccttactagaactatccaccgtcagtgacctagtgcgagccatcaccgggaaagtctctggcgatcagcggtttttctttccaaaagaaatgctcagcaaaaacgccgaaaacgatttattcaaaccaatttaccaagaattccagcaatatattttaaacgatcgtctggtcgtaccacactaattttggaggaattattattatgtcagtcaagcttatcgccatcgatatggacggcacgccttactcaatgagcacagcgaactaaatcccgcaaccgttcaagcgattaacgccgctaacgcgcaaggaatcaaagtcgtcatttgtacgggacggccattaagtggcgtcacgccctttttaaagcaacttggaatcgctggtgaagataattacgtcattacttttaatggctcaatggttcagacaatcaccggtaagatcatcacaggacttaccctgtcacatgacgattacatcgacattgaaacgctcagccgaaaactcaatatccattgtcacgttgaaagtgaagaccatatctacaccgccaatcgaaatatcagcccttatacggtcggcgaaagtgcactcgtcaatatgccgattcggttccggacaccggaagaaatgcgcccagacttaccaatcgtcaagtgcatgttcatcgatcacgccccactactggatgcagccatcaagcaattaccagcgtcattctccaagcgctttaccattgttcgctccgaagcgtatttcctagaattcatgaatcccgccgctagcaagggtaacgccctagccacgttgaccgaccatctgaacttaactgctgatgaagtcatggcgattggtgatcaaggtaacgatttgagtatgctgcgttacgcaaccaacagtgttgcgatgggtaacgccattgatgaggccaagcaaattgcccgttatgaaaccaagactaacgttgaagacggggtcgcacacgccattaacacttgggcactcgcctaagctactatttttcaaactaattcaagcaacgctaatggctcgtttttaacgtgccgtgagcgttgctttttatcactgttatgaccgttacccagcgttttctaaacaatccagtcaaacaaaaaagtgacgatcagtcattacctgatcgtcactttttaatgctggttattcgaaactaccagttgcactattttccttagtaacactaccactatccggataataacgataagtatccgttactgtcttggaagcagaataactagactcattcgtcgcatagattgcggtaatctgataataagcactggtctccttagtaatattaaattcggtatccgaagtaaacgtaacaccggacgcatcctgaaactgtttgatgatcgccgaagttgtcagctctgaagaactactgctggcagacgcgctgctattcgacgaactcgtcatcgttgaactatcggcactagtactactcgtactgcttgaagacgtcctactatcactcgcactagccgcagaactcgaactgacaaccgttgagctatcactaccagaactagttgattgcgacgcctcataattcataatggcttgtttcattgccaaagctttttctgtaatttttgataaccggatgtgtggcttgcacatcgtccaacttatcaatattggccttcgcagtggccaaatcatgaatacttaattcatcacgggcagcgttatagtaaccattggctagcttgaccgcctggtactgcttgacgagcttttgccgagcagcaataaaactggcgtcagtcgtgccatcataactgcttaacgtgtcaaaataaccctttgctagactgagctgattattatcaagtgcttcttcagcttcctgataatactttaacccaagggctaactttttgatcgctggagttgattcagaagcacccgctaaagtcttctgggcagcggcaattttttgttgcgaaatttgctgatcagctttggttaaaacggccgttgtactgttaccagttgcggtcgttgccgaacttgcggttacgcctccggtatttttggcacagcctgaaagtgtaatcaatccgagtaggacgattacaatcagtggccaagatgatcgataggcatgatccacggcaaacccctcctttttatcattctccattataccattaatcgcaatgtcatttttttcaaagctctcccgagtagcggctttgttaaattaacctaactaacgctgcgacataataagccgctaaaccaagtaccaccactaagttggcccagcgatacatcacaattaaggccaagtattcccgaaacatagcaaacggtaaataatacagtggcgtgtgcgcaccgattcccgttaggttcaggtgcagttgccgagcaaaaatattagcccgtaaaacgtgatagccactcgtgacaatcacggcgcgataaaacggttgttgccgcacaattaatgcgtgcgaaaattttagattttcaattgtcgacgttgaccgattttcttcttgaatggcatcacggggaccccttgatccactaagtactgccgcattgcggtactctccgccataacctcatccggtccctgaccaccagaaacaacgatcgtgattggttgatgataacgcgcccgttgcacccgatagtacttcgctgccgcctgaagccgatatgccagtgtgttcgcgttggctgcccatttggcatcaaccccgctcctaagacgatcatataatcgatctgtcgatgacgtcctagtcgggtcatgacgcaagctaatagatacgcgataaagctgaacgcaaaatacgccgtcaataataacgctaggcctaataactgccacaagcgtcgcgaatgccaaacgcctaagttgattactgataagaccagcattatgactaatacaccaccgacgattgctagcaagctgtaatgaaacgcccagccctccttgcgaatcaatcggtaactatacctgacaaaactaatgcccacaatcaaaattacaattggcaacaacgtataagccaaaatttttgcaccgaccaacatgaattgccaagtaggacttgcacgcgcactgaatcgatggtaagcgcttaacaaaatgccaatgactgcaatcaaaaaaagatgtccgttaaccaatgccgccggtccgtcaattgcaaggtcaacgcactagcaagggccaaactaccccaataaaacggtgtcatcgcaacaccccttaacttatattgtaatcggattcgtgctagtgtttattggataaaaaaggacgccggtagcccgacgttggtccgttatccgttccgcgccatcacctaattaatgttgaagcacgccaaaacgaaagattcgttgatatacggcgtccagtccaaccttgactaggtcataatgcccaccaaacaacacctttactctatcacttttagaaattactgcaacttaaaaagcgtcaaatcagcaattgccaatttgacgcttcgtcaattaattttcttcgttatggaaacgattcttaaataatggactaactggtttattttcatggataaacttgattgcttgacccattaattgaccaactgaaacttgttcgatcttatcgattcgcttagcagctggtaattcaattgaatccgtcacaactaatttcttaattggtgacttttttcaatccgttcgatggcaggaccagacagaactggatgcgtacaactggcgtaaacttcagttgcgcccgcatcaaccagtgcctgtgcacctaaagtaatcgtcccagccgtatcgatcatatcatcgatcatgatggcccgcttacccttgacatcaccgataatattcataacttcggcaacgttggcccgtggtcgacgcttatcaataatcgcgattggtgccttcaagaattcagctaatttacgtgcccgagtcacaccaccatggtcaggtgaaacaaccacagcattttcatccaagtggtggttcaggaagtagtcagctaacagtggcgcacccatcaagtgatccaacggaatatcgaagaagccttgaatttgggcagcatgaagatcgagtgccaaaatccgtgttgcaccggctgtttccagcatgtttgcaactaacttagcggtaattggttcgcgagaacgtgctttccgatcttgacgcagcatatccgtaataaggaataaccacgttaatggtcttagcactcgcgcgacgtagggcgtcaatcatgatcaatagttccatcaaattgtcattaacgggagcggaagttgattgaatgatataaacttgatcaccacgaatactttcctcaatgttaatgcgaatttcgccatcactaaagcgatcgaccgaagtcttacccaacttaaccccaacggcgtccgcgattttttctgccaatggtttatttgaattcaaagcaaagatttttaactttggatcaaaatactgttctgacataatttcctccattcgaaaatttattacttactaaataataggcattttgctagtgaaaatcaagtcccaacaacaaggcaaaattgcgtgagactgggctggaagcacgactttcggcaatctaagccccttcgtgattaaagattaaagtttcgtgagccccgattaccgaacaatcttagttaatgagaccgctatccagttgtaattggtactgacacacgcattgtaccagttattgccttagttggtacttgaccgctgccgtttctcgcgttcaaaagtagccagtactagaagtcggaatagagcgcacaccggctgacgaacaggaatctactagactgttcagttatctaaacacactcagtggtgctgatttaaataagtcacgacatcgcgccccaagcgattcatcccttgatattgttggtactgcttgccattctgggccatgacgacaatgctataagtgccttgtttggtcttaaaaatggccgcgtcgttttggacacccttatcgggatattcaccagttttattatagaccgtgacgtgtttaactaagtatggtagcttgctgtggttgcgacagcccttaagtaaggtcagcatcttcttatcatacatcttacctaataacttatgttgatatgtcagcgttaaaaaacgagttagatcagccaccgacgtgtaatttatcgcgtccccagcgtagcgcattcgtatcaagcatataccgttgtaaaaccgtctgcttgaatcgataatgcttaatggccgcattaacgcccctgaagcccccgcacgtttgattaaccggttagccgcgctattatcggaattatgaatcattaatttcaaatcattttgatcttgctgtgttagccgtaactttcgttgttggacccgtcgataaatcgtcagcatcacataaactttgatcgtactagcagaacgttgacgagtcatgcgctgatttcccgtttgcacggttagttttcgtcgatctaatcgggtcaccttgaccgaccagcgcccacctagcgatttcaaatcccgttgcgcgatttttttaacggctgtttgctcacttttaacgctagttgcgtgtactggtaatgcccagctccaaccgccaagcaatgccagaccacaaacaaggccgcgcatccacttcttcgtctgcatctaaatgccttcctccaaacttccccgtccgtaaactcctcgccaattataccaatttcgtgacttaattaaaatcactcagttgccctgaactgacacagtcaaatcaactttgtcctatttagcagctaaatagcccttattacaccacaagtcacgccgatgagctaacaaaaagagaccatcccagcaacaacgcacttggatggtctctgaattcaattatcaatgataataattacatgttttctggttcatgtggtaagcggccccagaagtcaggcttgttcgtctgacgtgcccgggcaattgccatatcatggaagttaacatcatcagtaatggtcgaaccagccgcgataaacgagtggtcagccacttcaactggcgcaatgatgttcgagttactaccaataaaggcggaatcgccgacattcgtgtggtgcttgttgactccgtcatagttaacgaagaccacaccacaaccaacgttaatatcttgacctaacgtttgcgtcaccaacataagtcaaatggccgaccttggtccgattaccaatcttagccttcttgacttcgacaaagttaccaagatggacgtgttcaccaatctcagcttgcggccgcaaatggctatacgggccaatattgctgtcagcgtgcatgatggaatcttccaagaaggaagccgtcacccgaacacgatcttcaatcaccatgtcatggatctcggagtgcgcgccgatgaagcaatcttcaccaattgtcgtatggcccttgatcaagacgcctggttcaataatcgtatcagcaccaatcttaacgcccgcatcaatataggtatcgtcagggttgataattgaaaccccattttccatatgctgcgcgttgatccgttgttgcatcactttggttgcttgggctagagctgcacgggtatttacccccattgattcatcaaaatcatccatttgataggcggcgaccacatcaccctgattcttcatgatcctgaatcacgtcagtcaaataatattcgccctgtgcattatcgttggtcacttcatgtaaggcggcaaacaacttctgattatcgaagcagtagactcccgtgttaatttcatgaatttcttgttcttccttagtcgcatccttttgttctacaatcttttcaacgatgcctaaccgattgcgaacaacccggccgtagccttgaggattaggtgccttggacgttaaaatcgtgccagcggcacccttagcttgatgatattcaaataattcttcaaaagtttcagctttaaataagggtgtgtcgccactgacgatcagcgtcatcccatccgcatcttttaagagcgattcggcttgtaatactgcgtgaccggttcctaattgttccgtttgaaccgcgtactcagttcggtcgcctaatgctgtttccacatctttggcaccgtggcctacaatggtcacgatatttgccatgtgggtggcttcaacttgggtcggaaagacgtggtcgaccatcgatttgccacagacctgatgtaatactttgactagcttggatttcatccgggtccctttaccagcggccatgatgattgcatttttggttgtcattacaaattactccttagtcctcagataagtccatcatatcaaaaactggtctggataacacaccaggctagacttccgcaccgaaaaccttctccaaatagttaccagcaacgactttaatcgccttgtcactatcactcacgttggttactcgtaataacgacgtgtagtcatcgattaaacgattgccaacaaaactggcttcggcaaaaacggtgatgccaattaaattagcatcaaattcttcaatcaaggtcttcatccgttgattgtgccgccgcccttcatgaaatcatccacgatgagcacgttggcgccttccgttaggcttcgcttggaaagttccatcttcttgatccgttctgaagaacccgagacatagttcacactaacggtcgagccttccgtaattttagaatcattgcggacaatcacaaacggcacgtttaaataagtcgcaacactttgggcaatcggaattcctttagttgcaacggtcataacagcgtcgattttttgattcaagtactgagtcgcaatcacccgacccacttggcgcaaaatatctggttggcctaaaatatcagataaataaacatagccacccggtaacacccgactcttgtcggcaaccttggtggtcatctcgtcaataaattcttgggcctcttcctttaaaatataaggaataaaccgcgcaccaccagcagcaccgggaatggtttccaagattcctgttccccgggcctgaaacactttcttcaaaatcgttaaatcttcactgattgacgactttgcggatgcgtaccgttccgcgaagtatgtcaatgaaactaatgtatggggacgttccaacaaatagcgcgtcatatctattaaacgttcgggcttctacgtactttcataacttccacctcaacctaaatcatcatttttaaagtctatgcaaaatgataacacaaacgttcggaaataagctaatttttttcacattttttactaaaccatcggaatttcttaatatgtttgccaatattctggtcagtacacctaataatggacgaatttgagaacaataaactagaatggaccaaatcagtcatcaaaatcacccataaataacagcaacggatgtacaactcagtcggtacaacaaaaaagctttcaagaagtagttaaccacttgaaagcttgcttatcagtgacagtcagataactgcccacacaatttttttttgattatcagtaacggtatcaacagcttaactaccaacgcgcaaccgctgataacccagcgcggcaaagtagaagatacactcgattgcagcgatgaagaaactgactggtaaattcgtgacgtaactcaagtacagccccagccaaaccccaatcaacgcgaaaccaatcgctagaaaaatcatcttgctaaccgtatggacaaagtatcgcgctgccgctgctggtaacgtgagtaagataaagatcagtaatgaccccacaatttgggcagccacgctgacgctcatcgcaacgagtaccaagaagaccactgagatgccggtcgtccataagccgctcacccgggcgccaatcgcatcgaaggaatcaaatttgagtggccggtacaagcccaacatcacgagtaggacgatggccgataagattgcgacccggatgacatccgcactggcaatcccaatcacactcccaaacaggatgctcgtcgcataactcgaagtttgattagataacgacaggaatagaatccctaagccgataaacagagcggaaattgcagaaatcgaggcttcgcgtcgtgattgtttcacactcatctgccccacgatgaccgaactaatcacggtaaaaatcagcatcccactcaagcgcggtccagcccataaaaatcccgaaggctgcaccggcaaacccaatttcagacagtgtgtgtgtcagaaatgagaggttcgggcaatcacgaaaacgccaatcgtcccacaaataattgcaataaaggttctgctaagtaggcgtttcgcataaatactaagctaaacattgacattagtggcctcctttaattgctctaccgacatatcagcgatattgccaaattgctggtggccgggctttaaggccagataatgtttggcgtattgcttcgctaatggcaagtcgtgcgtcacaaagaagacggtaatgttgctagtttggtttaagttctgaacgaggtccaacaattcatacttcatttcattgtccagactagccgtcgattcgtctaaaattaatagctgcggttgttgcacaattgcttgtgctaagtaagcccgctgcttttcaccaccagaagccatcccaagcggtcgctgacggagtttcttctcaaaattggtcacggctaatgctgtcgctacctgacgatgttcagctcgagacagccacggctgccacccttttaggttcagcccgacaaagtcctcaatcgttaacggatactcctggtctaagttgcgaaattggggcacgtagccaattttaatagctttttattcggataatacttaatttgaccggctgttggcttcagcatgccaagcaaggcgcgaattaaagtggtcttccccaccccattttcaccaatcacggtcaaaaagtcaccttgttcaatgttaaaattcaaatctttaaacacctggttgtttggaaagccaattccaaggtgttggacggcaattaacggttccgtcataacactaccccaactttctaaattaaagtaaatcgtaatgattactattttagtttacctgaatgcggtgatttgtcaatacctgagttcaaaatgccgcaatcattaccagccatggcaatcatcgggggcctaagtctcaaataacaccttgaccactagttgaatgcgcttgtcactaagacgagattgcaaaaaaaaagaccgtttttaccgttaagccggtaaaacacggtcaattcatgtttattattactttaatttaaggtgcttaagccaaccccgcctttgctcatgtaagaattcatccaacacttcttgatagcgatccgggtgcgttcggatggcttcaacgtgaccagcatcggggtcgatatacaggcccttttgttggggtagctggtcgtacaaggtatgtgcattgcggacaggcaccgtctgatccttggaaccatgaatcatcaagatcggtaacccgccatcaatcacccgttgcagaatccggccatccttaaacccatagcccgcgcgaacgtgtgctaagcgattcgccaccggcataatcggataggctggcaagtggaacttatgagtcagtctgaacttcgcttcatcataaagatccgcataacccgctatcctccacaatagctttaacattctccggtaacggctcaccactagtcgccatgaccgtggcggcccccatcgaaattcccatcaatacgatgtcaatatccagacctaattgactaagcgccatcgtaatccaacgttcataatctagtcggtctagccaaccataaccaatcgtatggccttgactatcaccaaatgaccgggcatcaggcatcaagacgtcatatcccaagctcataaagatgcgcgcatacggaatcatttgttcgcgcgaatgtcctagaccatgcgccaaaatcgccaagcggccaattgttttcggattagggatatatgttgccactaagttcagcccatcaaaggactggatcatccactgctgtttaggctgcttgaaataccaaaaattctcaatttcagtgttttctgcccgcgaacgttcgcggccccgctgcttctgtgcgtcactcacgtgcatcgcgacttgatacgcccgctaagccaccaagtaacgttcccgcataagttgcagcaccaatgacgcccgccaatttcaatccaaattttgtcgactgcttcatccgaacacctccgttactccttatttaatcataaacgcgcataaattgcttacaaaaagagattgcgttgtccgaataaccgatgatgcgttgaaggcaacgaccatcttcgtgtgtcaaacccgcaagcaaagccgcggctactcgcattccggtgccaattgcactgctacaccatctctggctggacacaggtcgtgatgacaaatggctcagcgctaccgtttaagcgtagcagtaaattagagactcggctcacctaagcccgtaccaataaaaaagcccaccatcacggcggactactgcggtctaatgttcatttaaattaactggcctcacaaggtatacttcccggcaaaaacccttcaaggaattatacactcgttgcgctcgcgattgtttgcgacacacacaccgaaaacagttggtccggtaccactcatctgggccgcatccgccccaaacgttaacaattgccgcttgatctgtaaaatctcggggtagcgttttgccgtgattggctctaaaacgttgcccatattcgcaaaaatctccgcaaaatcctcgctgttgaataccagccaacaaggcctcaatattgggatgctggtcgatgcgctcgtaattgacccgccgcaaaatatttggcgttgacacactgactttcggcttcgcgagaataatccacatcggcggcaacttaggcagtggggtaaccacatcgccttttcccgtcacgtgggccgtctgactgtagacacagtatggcacatccgaatctacttgcaatcccaaacgtgctaacgtggctaagtccaagtggagattccacatccggttcaagccccgtaaaacagcggcggcatcagatgagccgcctcctagaccagccgctaccggaatggcctttcttatatttttgatacggacaccccgatcaacatgacaataccgttttaaaacactcaccgcttgaaaagctaagttacggcgatcattcggcaaaaagccactatcggtgaccacttcgattcggttcgtatgcaatgattctaacatgacatagtcggccagatcgaccgacgtcatcaccatgtcccactctttatccccatttggatgttcaaataaggtatccagtcctaaattgattttggccggtgctttttcaacgatctgcacgcgtctcaccctcttccatgaccgcgattacccggggtcgctgacttactttgatacaattatactaatatcaaggcaaaataaaaagaccttgcttgggggtcttaatattgagaattcacgagacgcgaattaagcttcagttgtttcatcatcaaaagcgatttgaacgttctttgtcagaacatcagtataactgtaggagacccgttcaaatgcgttttcttgttgatctaaaatccacaacgaacaccgaacgataagtttctttcaagataccgtggcgttcagttgttttcttacggccagcctgggcaacgaccttcatgcgttggccgatccgtgagtcaagtttatctttaattgcagctagtgaaattggcattgagaatcctcctcatgaaagacactatactagcttttcacaaaaaagtcaatattatatcacaaggttttctaatgtgcaaccattttataagcatagataacttaaagtaagtcagcctgatgtaacgcatccgtcaatgtaataaattcatcgaccgtcaaccgttcggcacgaatcttgggatcaatcgtcgcgatatcaagagcctgttgaatggccgtcttcgtctcaggttgtttaccaaataggctttgcaaattattccacagatttttccggcggtgcgcaaagcccgctttaacgaccttgaaaaagctgcttcgtcaaatggcacgtgtgtccgcggtggcaatgccgtcaatttcacgattgcagaatcgacattcggtgacggcacgaaaaccgtccgggaacgaccatcgccatctcagcagccatccggtactgcacagcaatcgttaacgcaccgtacgccttcgtacccggttcagctgccaaacggtcggcaacttccttttgcatcatcacaacaatattttcaaaagcaacgtccccgccaaaatgttcatcagaataggcgttgtaatataatacggtaaattggcgacgagcttcaacggccgctcgttatctaaatgttcactgatcatcgcggctaagtcggccttcaaaatatcttggttaacgaccgttacattgtcataatcagctagtgtctcatccaaaattggcagtaaccgatcatcgatttcaaaggccaggacgtggtgcgcagcccgtgccaaatactcagtcagtgccccgatcccagggccaatttcaatcacgttatcattggttccaatgtcaaagcagtggcaacaatgttgtgtaacacgttctgatcagttaaaaaattctgtcctaaactcttcttaacttgtaacccgtacgtatgcataattgcccgtgtgcgggcgggattcgcaatatctaaatctctactcatcatttctcctctgtggttagttggccaacagccgcccaaaaatcagctggctgaatttgaaatagttgtaaccgtttgggcagctgtttaccgttgacgtatccgatacctaaacgttcacccaactgttcgcgtcgttgacgcgccgtgggaccagctagtaagcccgccgcaatcaaatcatggtgactgatcaactgttggggctcgtcgatttgctccgtatatagatgggcgagtgcagtttggatcgccgctgggctcgcgtgttcaacgcccaggctcccccagccttagttggtacaccagctttgcggggcaaaaaggcgtgcttgacacccggaacagccgccgaaatcgtccttttccgaatacgttcaccggaaaagtctgggtcggtgaacacgatcacgccgcgactggcccgcaacgttttgatctgggctaaggtggcttcggaaatcgccgagccattcgtttcaagtgtatctgcatcgacagctagggcgagacgcttcgtgtcatctttcccttcaaccacaattacttctttaatctttttcaatcttaaaaattcctctgcattttgataagtttgggccgctataatttccggcgtcgtttcacgtaactgggcaattgcttcaacaacgtaccgcgtgtaaccgggttcgttctgctttccccggtatggttccggcgttagataaggggcatccgtttcaaccagcatttgcgttagtggcgtttgcttgacggattcatggacttcacgcgcattcttaaatgatgcgacaccactataggaaatatgcatacctaagtccaagaaccgtttgagccactcagggtcaccattaaagcctatgcatgacgccacccgtgtcacgaatatcagctgctttcaagatcttataggtatcttcgaaagcatcacgattgtgcacggaaattggcaattgcatctctttagcaatggcgacttggcgggcaaagacttgccgctgaacgtcttgtggcgacgtatcccaatggtagtccagtccaatctcacctaacgcgacgactttcggatgttggacttgttcaatcaacaacttttcagccgcctgatcatagtttttggcatcttccgggtgccaaccaacaatcgcgaccaactgaggatacgtttccgccagtttaatcgcatcggcgttcagttgtgtattcgaaccaacgactgccatccgcgtaacatcaaggtcagccgcttgttgtaagtaacgtggcacttcctggatgaattcttcactatttaaatgggtatgagaatcaaaaatccgcatgtaataaccccttttcgacttttgttatcttagttgaattttaccatgggacgcaagttttcggaaaagaagacggtaattctaaaataaaaagcccgggttccccaggctttcaagcaaaatcaatgacgtacacgctgccaatacagccccgcgtacaccaccgtcatcaccgtgactacgcctaacatgtatacgggcaatgtcacgacactgccgtggtggagcaaactcattaagtaagttagcacactcactagcagataataacccaggctaaaccagccactagcactccccatcaccgtttcatagccaatcaaagcacgattcaacgcgtttggtagggtgatgttcagacctaagaaggctagaaaaatcccaatcagcatcccaatgacgtgattgccaacagcggtcatcaccaagccaactgccgctaccaaactcaatcctaagccacttaaagcgacccgcattggtgaccaatagttgacaagccaattcactagcaatgcgcccagcagactggccgcggctaagactaaaccgagactaccgtattgcacagcactaaagccgaagtgcgtttcaaaaataaacggcgcttcagcgtaataactaaacaagataccattaataccactaatcaataggccgtaacaccagaccacgggatcgtgcaataaccgtgaaacgacaacgctttgttgccgccaagaggccactttgaccgtttctggtcgagtctctggcaagcaacaccccgcgtacaacagtattacgactgctatcatgatcaagaccgagaagacatgctgatagccgaacacagtctggacgccacctccgatgagtggcccgagagcgggtgatagtgccatggccgcactcaccttcgcaaagatttttgcaccagtaacacccgtaaagatctcacgcatgatagtctgtgtcacaaccgaaccagcactagcaccgaaagcttggatcaagcggcaaaccaataaccaagtaaagcccgggctcagatattaaccctaagttaccaatcaaataaaaggctaatccacctaacatggcatcacggcgcccgcgatagtcagcatattgcccccagaagagcaccccaactgcaaaagccacaaaataactgctcatggttagctggctgtggctggcgctaacgtgcattgcctgactgagtgctggcaagatcggcgtaaaaattgattcactgatttgtggaaaacccactaatgtgattaacagtaataattatggcacttgtttttggacgtttttcatttaattaagtctcctaaatttaattaattttcggaaaaacgtccttttccatctacggagacgcatacgagaatctgttcatacttcatatgttctcacctcatttcttgttcgtactactgtacgggagattaacccatttgtcaaaaacaactaaaataacaattgaattacaaataaaaaatcgagctcactagtcagtgcgcccgattttttactcaacatttttaagtttttacgaaatcaatgatccgtttaccatattatctggtaccgtaattaattgcacctgaccgtcgtgttctgctgacagtaacatgccttggctcatttcaccacgaagcttccgtggctttaagttaccaacgatgataaccttcttgccaatcagttcttccggttctggataccacttagcaatacctgaaaggatttggcgatgatcagcatctccgcatctaaacggaattgtaggagtttgtcagcccctttcaatttctgcaccgtaatgacttcagcaactttcaattcgaccttgtcaaaatcatcaatggtaatcgctggtttagtgaggttcaaattagtctcagctgggttccagccttgttcgacttcagcttcatgtttcgcgttttccatggctttacgccccttctgtttgtcggatttcgtcatcttacccttcaagaattcaacttcggcatccatatcgacccgtgggaagatttggggttcccttagcaacgacttgtgcgccagccggcaaatcagccagttgtaagtcggcaattgctaaagttgctgggtccagccctaattgggtaaagatttccttaggtgcatgcgtcatgaccggactgatcaaactagcaatcacccgcaaactagctgctaaatgggccatcacactggctaacttatcagcatcattcgcatcgtcactcttagctaattgccaaggtgccgtttcatcaatatacttgttcgtccgactgaccaacttccacacttcagccagcgcatctgataaatgcaggctgtccatgcaagcgttgaagttcttaatagtcgtggcagctgtggcttctaagtcagcgtcaaattcagtcacaccggctttgaatgctggtaattgaccatcttcatatttattgatcatcgcaatggtccggttcagcaagtttcccaagtcattagccaagtcatagttaacccgcgccacaaagtcctcctctggtgtgaataaaccatcgttaccataaggcatggctttaactaaataataacgaagcgcatccaagccgtaacgttcaaccaatgtttcaggataaatcacgttacccttagacttggacattttgccgtccttcatcaataaccaaccatgaccaaagaccttcttaggtaatggtaacccgagtgcatgcaaaataattggccagtaaatcgtatggaagcgcacgatttctttaccaaccatttgaacatcggcggccagaacttgttaaacaagtcttcggagtcgccggttgcgtaacccagtgccgtaatatagtttgtcagggcatcaatccacacgtaaacgacgtgcttaggatcactcttgacagggacaccccaagtaaagctcgtccgagaaacggccaagtcttccagacctggtttaataaaattattgatcatttcggtcatccgattagctggttcaataaagtcaggatgactttgaataataatctaacaaccaatctgcgtacttactcatcttaaagaagtaggactgttctttaacaagttcgacttcatgaccactgggcgccttaccaccaataaccttgccgttatcatcacggaaaacttcagccagctgcgtttcagtgaagtattcttcgtcatcaacggagtaccagccttcgtactcacctaagtagatgtcaccatttttaagtaaccgatcgaaaatttcttggaccgcgcgttcatgataatcatcggtggtccgaataaacttgtcattagagatttctagcaattgccataaatccttgatttgttttgccatcccatcaacgtatgacttcggatcagtgttcaatttttctgctttttcttcaattttgaggccgtgttcatccgtcccggttaagaagtaaacatcgtaacccatcgcacgtttgtaacgtgctaaagtatcacacgcaattgtcgtgtatgaattaccgatgtgaacacaacttccccgaaggatagtagatcggcgtcgtaatataataagttggttttgtttctgccatgacgtaaattcccttcaaactggtttatgattaactcgttaagcatgtctttgattaaaatccatgaacaaatcacacgcgtccaaacaacacgtcttggtctaaaataacatgttgctgggccaatgtgtagaatctcttatattgtatcatatttcctgtgtttattaagaaacactaacaaaagagttctccacacgcaaagatcgtggcagactagtcaactgtgcaccatgcttcaaatggcccaaccaaccaccacaaaataaccgattaaaatcacgagttgattttaaccggtcattttgtggtaatctattattattcaacaacccacgaatatcgggccagcgcttcacgaacgacttccgcgatccggctatcgtccggccgacaccacttataatcataaacttccgagtcgactttgagcgcgccactccccgcaactaaaaacaatttaactcgactatttttcccggttgattataggccgtaccacggtgggtgaaggcccacttaaaccgatctggcgacacaactaatgacaactcttcttttaattctcgctgcagagtctgtgttagtttctctcccacaccgaccttgccaccaggaaaataataagctgtgtttttgattcccgtgttaataagacttttccatcagcgcagaaaaccccatttgcgcaaataatatccggttgcatacccaatccgccccaatctatattgttatgacctaacattcgattctcaacaacacttcaacccgccataactatctgcaactcacatagtggcgggcaactacttagttgcttgaactgaagtcagtgtatcttaatcacgcacttttctcaatcaccctaattcacctaagaatcatgaattaaggtacttataactgcctagttttaaggcagtcccaagccgtatcgtatccacgaccaacgagataattattaccaaaactaaacaggaatttacataaactacttcttgactttacactaactttacttacaaatgatgtatcccaaccgttcgctttcaaatcagatggctaaggccatattgattagctaaggtgtaagtgccaaaaaatgtagcggcagctcacattattgaatgttgaatgtccgaactaccgctacatttttagttgtcatgattcatcaattaaagaatattcaaccgtacgaccaaatttcaacggttcacggtcatagtgactgtattgagccaacatagtaattcaactgataactcgttcaattaagcaaagtatcacatcaatcactcataaatcattttaaaacaagtccagttgatgcggtcctaaatcaccaaacgaaacgcctagcaactctttgagtgccatcgcgttatcggccgcgtcaccaccagaattattattaaagatgacgcaaaccctttcgtccacttttgctgttgtaactgttccaccgtttgcttgaattcagctagtttttgatcactataccgatataaagtccgttggctacgccagttagcgcccttggctgaccagccccgctggttacgaccatgtaagcgtaagagtgccaatttcgaattcgttacgaccggctcgaaactaacgccatcatttaaagcgtgcggctcatcgacaatcacatgggtaatccccagatccttcagaaaactaaagaccgcatctttgacactctcctcgtaccaactctggttacgaaattcgactgcgattggaacaccgggtaaccactcgaccatccgttgtaggtaatggaagttgcggttcgaccgttcaaaaaacggcggaaattggaagagcaccgcttttaattgctggtgctgcgttaacggtttgagcatcgcacggtattcccgataagctgtctttagcgcatccatcgaaaccccttcgtcataagtgtcatgcagcgtcatcacctgatttgctttcaaaataaactgaaacttatcagggacggccttttgccacttcgcgaccgtcgtcactttcggaataccatagaatggcgtgtccacttcgacgactggtaggactcccgaatattcagttaaggtcagcttttcagtaccacccagtaaactagggtgttccgtccaagttgttaagccaattgttatcatcagacccgcaccccctcgaagaagtcgaccgcatcttgttgcaccatcgtaaatgcaaatggcaactggagcggttccgcattgattgcaagcacttgagccttcggattacgatagtcaattaggccggcgaacgggtacacccgaaacgaggtcccacaaataacgactaggtcagctgctgtaaatattgaactgcccgttcgatattggcactcgcaatcccctcgtcgtacaacaccacgttaggccgtaagtagccatggtctgtctgaatggtaaggagacttcaaatactcatgccaatcgacatgctgaccacacttggtgcagtagacctgatagagattaccgtgaaattcaacgagctgagccgttttagccaccccatataaattatcaatattttgtgtaatcacactggcccgcccttgctgagtcagtgccgccatctttgatgaatcacattcggttgggcgtctggatagtataaatttgattgtaaatattgataaaattccagcggatgctccgccaaaaacgcgtggcttaaataatactccgcgttatggtgttcggtatacagtccatttttagaccggtaatcaggaattcccgagggcgtcgaaacgccggcccccgtcataaaaacgatatgctgagcttgttgtaaagttgtttgtgctgctgtaatgtcactcattctgacatctcccgcttagcttaccgtaacgtatagggtagattcatttcttggaataattctttgaccgtgtctcttatcgtacacctctttgaaaaaggcatcgctcttcttttgcgccggtgctggtaggacaaacgcattctgacggtcactcttatataacccaatgtacgctcgggtatgtttatttttatctaatagatctgaatggtaaacgtcaaataactgccggacttccagccgctcttgccgttcactgagcacactctgaacggtcacaaattccgttccgtgtaggactggtaaatgccaagccgtcatctgatcatcaaaagccttgaacagctttactacggcacgccgcatcgcgaacggggtgtcaactggcttctgactgattacggcgtatagcttctgtgcagccggccaagcttgtggataggccgttgtcaccttttgcaaatcatcagctggtaattcaccattaaagaaaacgagtaggtcagtcaatgttaataaccgtaacgtcatcatcgcatccgccttgcccgcgggttccggttcgattgtgggccgccacaccttgcatgtatagcgtttcaatttgctcatcgattaagttatgttcccgttgtttgcgtacgaccaagacgtggctcaccatgtcataaagttccatagcgattgccatcaattgttcgtccagttgttgatcacgcgtggttaaattaaaggtaatctgtggaaagccttgtaataacaataatagatgtaataattcatgtgacgctgtgtaattaggagccgtaatatcgctaacccgaacggtcaggtcaccatcatctaacacttgttgtgcttgatcatggcggacgtaacccgcttttgtgtcaccaaaacgaacactaatattgcccggatataacgaattggcggtacttaataaatctgtaacagtttggttcaatttaatttcagtcatcagtctcttcctttgtttgccgcaattccgcaatgagttgttgcgtggttgcgaggtcttgttgagatgctaattcaagtcgttgataagataacggggagttcctcaggagtcgctcccgctgccatcgcgagcgatttcaactgtaggtgcatatggccccgctggataccagtcgtgaccaaggcgcgtaaagcggctagattttgggctaacccgatggcaaccataattctttccaaatcacccgctgtttgaatacctaatattcgttgattcaactgggctaactcgttaattttgattgaaccgcccacaatgccaaccggtagtggcaattccagttcaccatgcagcatccgaccatcactggtccaggtactcatgccacgatattgaccgtccttaacagcataggcgtgtgccccactctccaaagcgcgccagtcgttgccactagcaatagcgacagcatcaataccgttcatgatacctttattatgagtcgtggcccggtacggatcaagctgagcgaccgtactggccgacgcaatcttctgggcaactagtttgccggcataccgaccccagcctgtaataatccgaccggaatgtcacaaatggccttgactaagctcgccgttgcataattcgatagaatactcattaaagcgtcctgcttcgtcatcacaccgatggactttgccacggcttccaacatactattgagcatattggcccccatagcagccccgcacatcaacgaataggtcaattgataaatagccttgtccgagaacacgcgtacgtaggcgccgagcgccaccacctcgtttttttaaactgggatgggccgcatcagctacttttaataatgctgcagcgtgggcttcaatcacggcagcggttgcagccggatcagacaactgctccagaacgatttgaccaatcatttcacgttgattaaggacggtcgtgaagcccccgcacgcttgacaattttagcgccattacttgctgccgcaataacagaaggttcctcagtaaccattggaacaatgtgatccacgccatcgacgactaagttgacagccaaccccatcggtaatgggtaatccgtcaaataattctcaataatttcatgatgttgtggtaaataatattgtttaaataacgcctgttcagctggcgttaaatgggcctgttgcgccacgatggcagtgcgttccgcccaatttttttgataaaagtgccgaaaatcagctgtcatattctcattcctattctctccattcgactcatctaccgaaccgacctattgattgaggtgttctgaaataattccctcacgaacaccactttcagaaaagatcacccgatcactatccaacatctgtaataacgtcactagcggtaacattccaccaacaataatgtccgcacgatcatattccattcctgaaatttcctggcgacctttttttcgaccgtgacagtaagtccaaaaacgtgtggaacaccgtctctgtcttcagacgatacccgtgaatatcttcaacttttaacttttgttgccggcgccgattaatgcgggctaaggttcggttggcaccacccaatagaatgattgggaagtgcactgcttctgataaccaccaaatatctgccagtcggttacgtaggaacatctgcgcccgaaatagactcgcagacggcactaagtcgtcgagaccgaattgttccgataatgtcaccgcgccaaatggaatgctgatcagttgctgtttgcggccatttttgaccaagatcagttcacaacttgcgccacccgtgtctaagattaggcaatcatggatgaccaatgaattggcaaccccaagataatcgtaataggcctcatcgtcaccagataagactcgtaaatcgagccccacttcttgcttgacttgattgagaaattcagcctgattttgtgccatccgaactgcagctgtggtgatgccaataacatccgtattgggcattttttcataaagtcggcgaaaattgagtaacgccttgattgttcgctcaattgcggcgggctcagggtagtacgtgtgccgttcccattccttccgacaaacgcgtatcttccttaacacgcttgatttcttgagcagtgccgttagcatgcaaccgactgaccgccatccgcgccgaattggaccctaaatccacaatcgctaagtttctcataacaccacgctcacttttcgtttataaaatattagttaggtttattctaacatttatgatgtaacactgtgacttctagggccggattgcacaccaaaaaatatcaaaaagcccaaaatgaacgacgctagtgttttgactagggccgttcattttgggttcattagactagctagttggcagtaacgatcggagaactcgaacaacttcgtcccggtttaagtcaaaatcgggatctgatttaaatcgtttttgaatatttgctcgggctctgcttcaaccagctgaataaaactttttaaatcattctgacaagtccttggtacgacctttgagtcgaacgtttgattctcaataatcaaatcacacaaccggcagacatccttataatgtttgttcttattagcacgatgacgtaatttatcaccatttgctaaccgttgccgaatatcaagatgagctttggctttaaagtagatcaatccgggtacgcttaagatagaaacatggccaatcttttgctggcattgcttcaacaagctatagtaatcatcatttaatacaatcgccgacaaactagggcccgttgcaaaatgtaacggcattgtctctgtcggtaatctaagttcatagcgcaatggtatctttgaaaacatttcaatctgttggggacgcccgtgaccgcaagtgcgaggatctaacgcaaaccggtaatacactttcttcttattcacatcacccctatctcagcacacaagtagccatatttctcgataaagtcatcaaacttttgtgaaaagcccagttgactattttcaaatatgacgaccatatcgtaatcctgggtcgctctaaaatcctgatgatcttgcgctaaccaaattgcggcagcattgccaccaataataacgtaacaatcttcatagccttcgaaaaagtcaaagaacttgtgaaatagcatcaccttatgctccgttccaaatttgatcaaccaattcttcggcttcgccttgagtccgctcgtccatatcatttctaaatagtacgtataaatgaaagggatccaacacattcttaggataattggcaattagtctaaacaatgtgttaaaaccgctgagctgatactttgaaacttgcacctcacaagcgactttccgctcatcggtatctgcgtcaaccgttgtcctcaaggtttgccgtcgagaacggtccataataactgtctgttgcttccgattatcactgatcatcgtcactttagataaaccagtaaggccggaataaagaaaattcttactagctgattcaactgatgctttcgccaactgcaccaagtcaacagattgaactggcgacactaagaatggcgctatctgatcaaaaaaacggcggctatctaactcgcaagtatagacgcgctccttagtctcgccgattgacttcagccaaccatgtgcaactaacggtttaaccgctcgactaaaggtaactcgattattgatgctaacttgcttgccaatcgttgatgcaaagcattgtccgcttttgatcaagaaacggtcatcagtcgttctgaaggctgctaactcgggacatactttggccttctctggatgacgttcaaaaatcaactgtgctaatacgatggttaatgctagtcgttgtgccgcggaggctaaaggattgcccgctattccaggtgagtcattcacggcttcaggtaataaccgtgtccccataaacggcaaaaacatttcaccatctgatgtcataaatggcattctgtttttcaaatattcgtgacgctcattggcggaaagctgaggaaaaataaacaccaatggggtctctcgatttacctgactaactcgtgcatagagccctagtggccgcaaatcgcgctgaccaccataagacataaaaaggaccggcttatcaaggattgtcccccgcacaaccaccgtattattttgatccgaacgactcaacgacaatgtcgacgttgaaaccgattcgccaatagttaccgggatacccgtactttgactaatatattctagttggttaacaagctttatcacattcttcgccccctccatccaaatgattgtaacatgttttcttcgattgtaacgcagtaatgttacaatcgttttaaatgatgttacaatcatcctaattagctgagctacaagcaaaaattaacactatcacgtgaccgaaacttgttattgagcacctcctcattaatcagatagacacggcaatcgtccgtaattactccgctagtcattgccatcagtcattatttacgtcaattgacgcctgttccacttaaaagtgactcaaagtttttttctaaaaaaacgtcgaattgaacagctgttggaccaactcctaacaagggcctaaatttgaatacaattgtcatacccctttagatacaaaaacatcccaacattagcactcactgccgatatcgagatgtttctatataataagtattgaagtttattaacgtattactgccttaatcaacctgtctgctgctgacactaactgtgattggtcacccgcattttggcttgataagccgctaaaattttgcgtacatcatccgttgacttggcatccatcatcgtgttacgcaggtcagtggcgcctagttctgggcgcgcatagattttaaagaaccgttttaaggacggaaaacgtggcacgtcataacgggtggcaaagtcatcgaacaagtcgagctgcatgttcagtaaacctaatagttcatgcaaatcatgcgattggggatgggactcaaatgcaaacggattcgcgaacactccccgaccaatcatgataccatctaatccaggatgtgctttggctaacgccaccccggcctgataatcagccacgtcaccattaatctggagtaacgtttccggggcgattgcatcacgcattttaatcaagtcatctacaacttcaaagtgcgcgggaaccttactcatttcctgtttggtccgcaagtgaacggtcaagactgccacatgttgcgataacaacgttgcaatccagtcatgatattcagcaactttactgtaacctaagcgcgtcttcgcactaacggccagtccagacgtctttgcagccgcaatcacgtcttcagcccactgcggattgcgaatcaaatcgctgccaccatgatttttgatgaccgtcccatccgggcagcccatattgatatcaactgcttcaaagccccggtcacgaagttcagctgtagccgaagcaaagtcagccgcttcgttaccccacagttgaacgaccggtttttgcgactcagctgctgccgccacgtacaaacgaccatgcaccggaaacttcgtattcgggttcgcaatactcttagcatagacgaattcactaaaaacgtatctggagcagcggcatggctaatgacttgccgaaaaacagtattactaacggcttccatcggggccatcgtaaaaaatggtcgcccgtctgccttggcttgggccgcaatttgcgaccagaatggtgttgctgtcacgttctcatactcccttatcactagtttaacttttggattgaatgcttttaattttagcattgatatgcacgctttgcgggaatgacgtttgctggctaaataaattaaaagtttactcaaaccggtgttggacgacttcttgatgacgaagttcccgtaacagtgcctcaataatgtaaaggcatggcacttggctagttaagtcataatattgatgaatacgctcctcagtcgcccgatatgttaacgcatatcgactcattcgagcaatcgtactctcaaagattactcgtaatactaataatattgacttcaggattattcacaaagtcattaagcatttcaaccaactcagacgtctgaccggagactgacactgccaccaaaacgttattactagtattacgtaattgtggtaatagtggatagaaaggatccttgacgacataactattaaatcctaatgatgacgtttgacgtgaagcatactcgcccaacgccgctgatgctccgataccaacaaacacgatattatccgcattgaccatcaactgagctgccagtcgaataatcttagtaatatctgcgggaaaggcactcggttgaacaaactgaatacctggagcatccggcttttgaatgggcgtttcactgcgtagcgatactttaaattctggaaaactatcatacccaattttacgaataaagcgcatgactgacgaattagaaacgtgcgcaccccgcgctaactcacggactcgcatatacgggatttgctcatccatgctccacaataaatcgataaattgctaaatctactccagataacttatcgatatccttatagccaaagaatgccacggttagccaccaccctatctaataatctattcactagattaccataaatgcgtaaccgcttctaaaaacatctagcattcaagctttttcattttttaaattaaaatacgtgtcaccctattttaataaaccagtttgatccgcctttttaaccacgcttaatcaactgatacactgccccaatcatcccagcatcattccgcaatttagctggtactactgatgccaaagtcaaatgattaatactattatgattagcctgtaagtctgcaatcgttgcattcaaatcagtcataaaggtcgtgttcgcactaatgccaccaccaattacgactaattcgggatcaaaagcaaccattaaattaatgattcctttagccaaactgtaatagtagctatgaaagacatgttgtgccagcactttctcccgcatctgctcggtcaaaaatctcgcgcgcgtcagtaaccggcatcgcactaaactgattataacgtcgtatgagaccgataactgttgcaccccggaaattaagggttcccatttcagtatcaatctcatcatcgtcaacaaccatccaaccaaattcgcctgaacgcgcgtgtgcaccccgataaatctgattattgataaccagtgccccaccgaccccggttccaagaaccaagcttaaataattaggcacattctgagctactcccagccattgctcagcaatagccgctgcgttggcatcattttcaataatgaccggtaactgcgtctgtgcatgtaactcagcttgcaagttaatttttcaaacgccgtgaccgcacccgccgtcgtcaagaagccgtcactttgaacaactcccggcatgctaactccaataccagcaacttgtccatctgcttgtagtccttgaatcatcgcaactaaatcggcccccataatgtctacctttgctgtggcagtcggtcgtgttactttacgactaatatgtccatgagcatcaactaggccgcacttgattgaagtaccaccaatatcaattccaatatacattgtcatttaacagtcctcctaaacgcccaatggccagctatcaaagctggccattgacaactatttcaaacatcattaattaagcactagtcaataattaatgaccatcgtcatacccaaatcgcactactcaatttcggcaccatttgtcgcaatcacatgttgaaaccaagtaaatgaatcctttttataacgttttagactacctgaaccatcatcgttctcatcaacatagataaacccatagcgtttggacatttgaccagtactagccgcaactaaatcaatgcacccccatggcgtatacccaattaaatcaaccccatcttccagaactgccagcttaatttgtcgtaaatgatccgttaaatagtcaatccgatttaatcgtcatgtatctggttatctgccgtcttcttatcaattgcgcctaaaccgttttccacgataaacagtggcaaatggtaacgatccgtgaaccaattcatagcatagcgtaacccaacgggatcaacttgccagccccaatcactagccttaacatatggatttttaactaaatcatgttcttcattataagctagctttcctgtgtccttcacagtaaacgacatgtaatagctaaatccaatataatctaccgttccagcttgcaagattttcaaatcttctgccgtaatgtccaagttaaaatgctccgactcaaaacgattacgcaaccattgtgggtaagtgccattgcaatgaacatcggcaaaataaaatcgggtttgcatcgctcgttgcgcaaataagacgtctgctggtgctgctgtaagcggatagatcggacacatcgcaatcatacaaccgatttgaaaatctggattaatctgatggcctatactgtaccgccgcggcactcgccaccagttcatagtgagccgcctgatacatccagcgttcacggttttctcctggttgatgaatgattccagaatctgttaacatggcaccgtctgattcaaaattagtttgattgttgatttcattaaaagtcatccagtacgttactttatctcgataacgttcaaaacatacttttgcaaagtttaaatagaattgaataagcttacgattacgccacccaccgtattgcttaactaagtgatatggcatttcaaagtgtgctagtgtcactactggttgaatcccatttttaaggcattcatcaaataaatcatcataaaattgtaatccagcttcattcggttcgctttcatcaccattggggaagatccgcgtccaggcaatcgatgttcgaaaacacttaaaccccatttcagcaaacaattcaatatcttcgggataacgatgataaaaatcaattgcctgatgattaggataatacttgccagccactactccgtccgtaatttcacgagggcgctcattcgtccctaatgtcataatatctgccgtactgagacccttgccgccctctttataaccaccttcgagttgatgtgcagccactgcgccaccccataagaacccttctggaaacgctcgtcctttaatcgtcatgttaaactccttttaaactatgctttaaccgtttctgtcgtcgtatccgtatcttgtttagattgactatctgcagccatcatcttattggcagcgagtacaaatggcatgtacgtcaacacggaaattcccaaacaaacaaatccaataatcaggccaagccaattgccaccagtccccaagaacggcatcagtggtcccggtgttgtccatgtcaatccaaaagccggcgtcggtatccagttaaaaataactgtcactgtatagccaaccaagatattgatcactggtgttagaacgaatggaatcgccataataattggattcaaaacaattggtaaaccgaacattagcggttcgttaatattgaagaggccgggcactaatgccaatttagcaatctcacgataatctttacgccttgagacgaggaagatagcaataatcaagccaagtgtcatcccactaccacccatattggcgaagacatcattcaacacactccaggttgcacggttgggcacaccccaagctgtaccatgagcgttaataaacgtttggtttttcaaatcagcttcagtaaaaataattgatcgtaacgcgttcaacgtgtttggaccatggataccgacaagccacaaaagattttgaacaatagcaataatgataacgccaaataagttgaccccaatgtgggttaatggtgtttgaattgatttataaataatatcattgattccttgtggtgaaattagtgataacccatagttcaacatagaaaacagcataatcataataacgataggaattaaagccattgaaagaccgtgcaactgccggcggaaccatctcaggcattttgatttgcattttcttaatgcgcgttagccgtggtaaaaattctccaactaagccacctactatcattgcaacaaacagcccttgtgcacctaaataagtcgttggcaaataggttacaccgtctttgataattgatggtgagtataaaatcatgaagcaggcaatccccgtcatccctactaacatgtcatcagctttaaaatatttggccaaattccgtgccaccagatacgcaataaaaatcgataaaatattcatcgttccgttagttactgaggttaataacttttgggcattttccaagtgtggaaaaaatttgggtaaaaataagatttgtgcaataaaccccgtttttgaaaaaactaagttattaattaaaataactaacgatgcagccattgtaattgggaatgtgtacataaaagcatcacggattgccgcgacatgtcgctgttcattcaacttgactgcaaatggtacaatgtgtttttccataaacacgttaaaaccgttcatcataagttgttcctccctttgatttaacttacaaaagctagtataagtgaactacatgcgttttaaaagcgcttacaatgcagttgctcacttgttccatcgtgatggtatcacgaccacatctgaaacgctgtgtaccatatctgttcaaaaaagtactgtaaatccacttacggatttacagcactcttctaacgaaatcaatttttgaatccagcccgcttattgattataactagcagccatctgattcatcatcttcttaaagcggcgtttacggaaccatcctaagaatagcacgccaagcttattattggcattcgtcttcttatccttgcctaaaaaggtttcggcatattctaagacagtttggtgaccatcagtgtccggtgcgaattgataatcgacgccgtaatgatcgcggggcgtttctaattcatacgcatatcgaacaccgggttgcgcgtgggtaatcttcaaattaccggtcagaccgttggaccactgtttggcatactcatagccttgtaagctctgccgtggcgccggccgacccgtttgctgctgaatatcagcccgcgcggaatcgatcaactgttggtataaataatccacaggggcgttcaaagttaatttaatctgcattctggtggctcctttctatctgacccactcgccgataaacgacgaaaagtgctgcgctgaccgctaaacctaatccgagcgtcacccattgaccggtcgttccggccagggacttaagataacggctaataatccaaggttcatcccgatgagtaaacactgctttaagcttttcatgacaatctattctccaatcgctgctggtttaatcttgttggcagccttaacgaatggcacgtaaatcgcaaaggcaacggcggcattaaataattgtaagaccactgaccgcccagtccattgtggcaactaaggcgttcataatcggtggcattgaccaaacgatattgttcgtaatcggtgcgacccacccagctgataaagcagcgtaggcgatcgaaacagtcacaactggtgctaaaacgaacggaataaagtagattgggtcaagtacaattggcatcccgaacatcacgggttcgttaatattaaagaatccggggccaatcgccaacttagccactgaacgttggtcgtctcgtttactaaatactaaaatcgctactaataatagtaaggtcgagccggccccaccaatccatgcatataagtcaaaacagttccgcgtccaaacgtatggcaaggctttgccagcttggtaagcgttaacattagcaagctgagccgtcaaccagattccgtccaagattggtgccaggacattggaaccatgaatcccgaagaaccagaaaacttgaactaacagcgtcattaagaggacggcgccgtaccccttgactcatattcaatagtggttcttgaataatcttcgcgatccattcaatcaccgtggtgttgaatttactgaagatccagttaataatcccaacgacataaaatgcagcggcggctgggataaccccagtgaaggcgtttgcaactgccggtggcacagaatctggcatcttgattgtaatgtgtttcttcatcaaagcaatgtaaacggcactcgcaatggcccctaaaatcatgaccgtaaagaaaccatacgaaccaaagtacgtgttgaagttgaagtaaccccaagccgtcactttttgccagcaaccgccatgccagagtccgtcaacatcttagtagcgcccttgctcaacgtactcgtcaacgtgccggtaaagttttgtggcaaactcatgatgaaagttccaagtgtcacgatcccaccagtaactggttcaactttgtactggattgccaattgatacccgaatgtaaatgagaaaatcagacctaagatggctaacgtccccgtccaaaccatcgcattaattccaatcaaccactgcatcgaattaacaatgcccatccaaccgaacttcgttggaatatctcgaactaaagcgttcagaaccgtggcgatcgacccggccatcattgccggcataattgctataaacgcgtcacgtaatgcgatcaaccaccgaactgcaccaatcttggccgcaactggcactaagtgtttgttaagccattcgataaatgaattcataatatacccctcactcctaatgtaggttttcgctagttagtgacccaacacaactgttgcgtcacccccgtactagttttgtaaatcaatattttcggtatggtaatagagttccaaatctggatagacgaagaacgtcctggagaagttaaagaccgtcccattagccaagtaattgattgcttccaagcacaacgttttgtcaccatctgggcaaccgatcaactccgcccgttgcgcgtctccacccgcacttgatggacgtagttttccgtggtgctccccgtaataccatatgcctctcgcaagaaggcgaagattgaatgctgcacgctctcactcgataagaacgggacgaccgttcgcggaaaataaaactcttccaggtcatacaagatgtcattcaaataacgtaatcgcaccacccgataaacctcgtcaccaagcgcaatgttcccctgttgtgctaaagtttcatccgctgtcactttatcaaacgtgacaacttttgatactaatggtccaccctcaaccatggcggactggtcaaatccaatcgataagttgagcactttcttcgtgttctgcggttgtttgataataaaattgccgctccccgcacacgacgcaacaacccatgccggaagaccacatcaatcgctttacgaatcgtattgcgactggcgttgtactgcgccattaacactttttcggttggtaacttagtcggatattcatccgccattatcgatttaatgattgcctgcgcaattgcctgatacatgactaaacctcctttcgataaattagtaggtgcttgtaaaacttgtgcccacaaattatattatcacagaagatatgaaaacgctttatttttcgtgattttataccaatgaatttatattatgactaaaggcagccacagcaagcgctttcgaattccttaccaccccttttcttgccaaaaacttattttaacaagcactttttacaatcattcatgtaagaaagcaaacgaaatcagcctaattttcaatttagtctgccttttctttttaattcgcaaccgtgatgcgttgggccatcgttattaatttaccagaaagccccatatattaagggtctacaaaaagtgcaactcaccgtcttcacacatccgacggtcagttgcactattttctaccatgatttatttaaaataattaattccaatggcgtcttgcatctcacgccacgtttggtcagcgaccacgttcgctttcgctgtaccatccttcaaaatttgtaagacttgagctggatcagcttcgtaaattgcacgccgttcgcggattggccgcaatacaccgtccaacacgtccatcaagtagcgtttaatcttaacgtcacccaagccaccatgttggtaggcggccttcaagtctgcgaccttggccttgtcttcatcgaaaatatcaagatacgtgaagaccacgttaccttcgaccttacccggatcttcaatatgaatatgatcaggatcggtatacatggacatgactttcttcttcaaagtatcggcatcgtcagaaaggtaaatcgcatttcctagtgatttactcattttggcattgccgtcaagtccagggattcggcccaagccctttggtgggaagtagccttcaggttcaaccaacgtgtcagtttggtaagtcttattgaagctccgtacgatttcacgggtctgttcgagcattggttccttgatcgtcaccaacgggaacagtcgtcgccttgaaagccgtaatatcagcggcctgactgactggataaacaaagaaaccggcgggaacactttcaccaaaagctttttgcttgatttccgtcttcacagttgggttacgattcaagcgcgctaccgtcactaagttcaagtattgattcatcatgtcagttaatgctggaatttgagactggactaagatcgttgacttttggggatcgattcccactgccaagtagtccatcgcaacttgtaataaacttttacgaattttttcgggatcatgcgcattatccgtcaacgcctggttatccgcaatcataatgtatgagtcatagtccccagaatcttgtaatgcgacccggttacgtaatgaaccgacatagtgcccgatatgcagcttaccagtggggcgatcacccgttaaaatcacttttttgtcattgtattcatcctttctattggcactaaaaaagcgctccctgatcaactaatactagttaattaggacgcatcaccgtggtaccacctaaattgcagaaagcttgtctctgccactcattgaccgataagggtgggtccccggtgttcaccgaatctccaaaaagccaattcattagtccgccccagctttcagcacgcgctaggtctctgttattggacgccttactgttcttttcttcaacgattaattagttctagtgtactggttatacctgaccgtgtcaaaataaattctggacatcattcgcgttaactagccgctaccatttcaacataacgatcgtcatttcgacgtttaagcccatcgaaattcaagcgggcgttccttcaacaccattaaaattcagttaagtgctcccagccccagtccccaatttacgcttcagtataattccgggcgccggtcttcaaacactggaatctgaccacgaacctggtcaacttgtgttaaatcaagctcggccgtaatcaactgggcatgggcaccaccgatagccacaatttggccgagcgggtcaataactagtgactgaccaccaaattgattatcaggatcactgccaacgcggttaaccgcaaccacgaatgcttgattttcaatcgcacgtgcttgcagtaatagccgccattgcatctgccgcactgtcggccactcagcactgacaaaaatcacttgggggccacgggctgcttctttacgaagccattctgggaaacgaatgtcataacaaatcgcccccatcgcaacagttccgtcgagttcaaaaacgttctcggtctcaccagcagtaatataacggtcttccgccattaacccaaaccggtggactttatcgtaacgactcagtaactgtccctgacgatcgacgactaacatctcattatagtaatgcccatcgcgagcgaccgcgactgagccaccgacaatgttgacgcaaaactgccgagctaacttgctgagtaattgtaacgttcggctgcccatcatcatccgccaagacattcaggcgagttaacgcataaccggtattccacatctccggtaagacgatcacgtcgacagtttgctcagctgcccgttgaatggccacttcaatctgctcgtagttggcatccggatctccaaactgaatattaagttgtgctagtgcgacacgcattcgttccacccactttattagaatgattaaaataatattagaataaatagtcataggttgcaagcttcagccttgccatcgtaaagctgccgaacttgcccaccgttggccagcacgccttagtgccactcataatcacatttcacaacaattactgataaatcagtgaatttgcggcgctttgattgacatcacccccaaacccgcctaaaattgttcaagcgatttagacgattatcagacgggaggccctctacgtggcaacatcagatcaagagcaacaacgcgaacaacaacgggttgatcgagtcactcgagcaagttaaagaacgggcacaacagaccgacgacttgctggcaaaggctcatcacgaaaccgatgtcattcagaaaaactatggtgataataattccgtcaacacgtttgaagtcgatgaccggattgaaacgaacgcggaactgcaacaacaaaagcaaatggttgaacgcgccgtggaatccgaagccatcttgaaacggcaagtcggtgtcttgaaagatctcagtaactcaccctattttgggcgcattgatattcaagatagtcccgacgaggaagccgaacgtttatacattggcaccgcctcatttgtcgacgctgaacagaatttcttagtttacgactggcgcgccccgatttcctcagtctactacaatggtactctgggtcaggtccagtaccaaacaccggccgggcagcagacgaccgagctgatcaagaaacgccaattccagattaatcatggtcagatcaagaatatgttcgacacgatatatgaaacggtcggtgacgaaatcttgcaggccgtccttggagaacaaaatgatgcctacatgcaaaatattgtagcaaccattcaaaaagaacagaacgatattattcgtgacaccactagtgacttactagttgtccaaggggttgccggctctggaaagacgtccgccattttacaacggatcgcttttctgctctaccactcacgggcttccctagaagcggaccaaatggtattattctcgcccaaccgcttattcagtcactacatctccgaagtcttacctagtttagggagcgcaatatgcgtcaagtcacgcttgccgaatttctcagtgcacgttttcaaggcctaaccgttgaaagcctatttgagcgctacgaaagtgaccgccagcgtgaacaactgacaccggcaattcgcgattttcaagaaagcgccgactttatgcgccaagtcgatcaatattgccatcagctaccagccgaccaattagtacgcttcacaaacatcgtctttaatggcgaaattttcttcgctaaagaggtcattacaaagattgcgacggccttaccagcagcgatgcaaccagctgaccgtttcctagcaatcaagaacactttgattaaacgcttaaagcatcgcattgacgatgaagcccaagctgactgggtcaatgatatcattgaccaattgagcgacgaagcttaccacgacttattaggttccaagcgccgcggtgattttcaatcactcgacgatgaagtcttctatattggtaagcaaatcgtgaccaaacgactgcggcaagtctacgatgcgatctataatggttacttcttagacacctatgaacaatataacgatttcttagcgcaagttgattggcccactaccgtgacgtctgaccaatggcaacaacgaattgccgcttaccaggccgccgttgagtaccatcggattgctctggttgactgcgcgccactattgttattacgcgacgatgtcctaactggcagtggtcagaaccggcggatgcaatatatctttgtcgatgagatgcaagactattcgctagcacaactgttatatatcaagcacgcgttcccactagctaagttcacactgttaggtgacagtgaacaagcattattcaaggggattgagttaccacagcaattactggaacgcctcaaggatgctttcaatgtccgacgggcgaacttgattacgttgaataagagctaccgttcgaccgaacagattacgaactttgctaaagcgctattacccgacggcgaccagattcaagcgttcacacgtaaaggcgatttacctaaagtcatgattcgctatggcgaagacgccgctctcagcagtctgcgtagcgaagttgaacatcagctcaagtcaactaacaccgttgccgtactaactaaagatttagcagaaagcaagcaagtctaccaatacctgaaacgctatacagtaacaacgttgatgtggccgatagcgaccgtaccatgccacaaggcgtgattgttatgccaatctaccttgcaaaggggctagaatttgacgcggtggtcgcatacaatgtctccgctaccaattatcccgatgcggattcagttggcatcttatatacgattgcgtcacgagcgatgcaccacttgacattgctcagcatcggtgatgtctccccactaattgcccagttggacccgacattatttacgattgaacatcaggtacgagtataactggaattaaaaaacgactggaagtagcccagcggtattacgctagctacttccagtcgtttttcgttatcacgaaactaatgcttgaccatttttaaacatggctatctgtgcaaaatttcatatatggagccttaatatactctgttttattattatctttatgaacagccacaaatccattgctatccggcaagtctattttagtaacgctttctttacctactttatattcatagaatattactatctaaaattttcgaaccattagagaattcaaacgatataatttcatccatacttaccaaactccttctgatatcacatatccatcaattacagttttcagaaccaactttgtatttttatcaccgtattcacaatattcttactacctgttaccttgttcactttagcataatccaaagtaactattttagctaggaaccaaccagagtatccccagatttgctaacatatgtgtcacgctattcacacgaatatcatgcttagataataggtagatggtccccagcaccatgccgaatagcgtgtaatatgctaatggcaccaagctatttccgctatgcagataaccgaaaagaagcccattgataacaatggtagccgcttggtactcccggtcaagatattggtctgacaagacgtaactaaagaaaaagcccctgaaactcagctcctcagcgattggtccaaaaatgacggcatcgagtgtcatcgctacccggatttttccgcaacagtaaatctaatgcacgttcattacccgattcagtgatgtgccataccgccgtcagcttagcatagccaaaagcaagcgccacgataatgactgcgccgatcaccatgagtagcaaggcccgtttatttagccgcgttcgccacggtcgaaaatcaaattgccgcaattccgcggtcgtcttatagatgttgtacaagaaaacgataatcacggcatataaactgaagctaactaacagtgtaaaccaattggccgtaatcaagtaaatatacacgggtaaggaactgatattgacaataacacactcacaattagtaaattaccaataaaccgtaaattcttctgtaacatttcatccactccatccaaacaaccgtaactagaatgttcactaacgggcttttaaatcaacccactcaagttacttgccaagattagctgtgacgtgcacgacactgttgactcgaatatcccggccagataatatgtaggttgccgcgagtacgagacccataaccgtatagtatgacaactgcacccaactaaaaccgccacgcagtagaccaaacaacacgccgttaacaataacggtaactagttggtatcgtggctgatcaaaacgttccgccagcgcataactgaagaaattgccgcgaataattaattcctcacaaatcggtgcaaaaacacccagggccaacgccatcaatatcggtgagcgctgagacaatgcttgcaagtcagcaacattctccgcgattgaatagacagcatcactaacaaatttaacttgcaccgctgccaaaatcagcatgaccaccattgccagtaccgtaatcactaattgacgcgcgctcggcttagcagctattttcgtaatcttaaaatgattattagtaactgattccagataaattcgatagaataaataaattgcaaacaggtagacgaccaagaagatcgccaccgttatccagttactacttgagtgttaaaatatcgatgggcgccgtactaagacccatcacgattgctgccaataaactggcaagtagtaatctactaataaatttgacgttttgatgtaccatgctccttcacattcatttcttgataattatccccaatggtacctaatccacaacttgcggtttgaccggatatcactaactgaaacttatccccacatcatgttaataagtgtgaccagccagttcaccagtatatgacatcccattgcggtactcagttgttttgttttgagtactaaccatgaaaaaccgcaccctgtaatgaagatgcccaccgtactggctaactgataaccatggccgagtgcgaatactgcgtttgtcagtataatcgcgcccaatactggcaagtatcgtcgcagcgtattttgaacaattccacggaaaagtaattcttcgagtacggggctaacgatgtttgtgcacactaatgttaataaccccaatgggactgtggatcagtgccatgatttcatcattttgtgtttcagttggactgactagcagaccacttatccccatttgaatcaccacgaccaccactgccactaaagcagtcagccccatcattgaccaagaaaaaggcactaacaggactggcatctcaaaataatggtgatagcaacgtactagtacgaccgcaacaccaacggttaaaacgactaatgctacccaatgataaccgatgttgatttgttgcgggcgttcaccccaccaattccaatagccatccgctaacaccggtaattgaatgaatataaatagccctaaacccgctaacacataaccaaataccctgagcaatcgagcaaccataccaagcctcccaagttatcccctgtggataaactaattcttatgttttaatttttcatccacaacattaactcatagccgccaacgcgaaaactgccaaattagtccccatgtgcaccagaatattttcagaaatctaatatcgcgcttagccaacaaataagttgtccccaagatgcccccattaacgtataataaatccacggctcccaatttgcatcaacatggacacttgcaaatattaagctattaataacaaccgcgattatctgataattacggtgattatactgattcgttaacgcgtagctgaaaaagataccgcgaaaaatcaattcctcacagatggggaaaatatcacgaccgaaacaatcatgggaagcggtgcttcaccgagcatccatgccaacgacctggaattgctggtctcgggaatatttagcatcgcgctcaatttaagatcaacaataatgagcacgaccattgtcagcatcgcaataatcacagtccctaattgtgcaatgttcacccgggacttcaacgtcgcgacttggtaatgcctaactcgtgctgtatgccgataaagccaatatagcccccaagcttccaaggcatagattacaaaaccaatcgtgatcatgagccaattattcttaattaggaaaagatacgccggtgccatactaaaactcaccaatgctaagctgattagactggcaatgactaggttaatgatgaattgtttatttgagtgtgccattacttacctctttcgtatgatatatgtgcttctagataactttactttaccacagtgatatttagtcagttagtactgatggtcaatcatcaattattatccagcaccttatctttataataatcaaaccaagtcaccttgcccgtaataatcgtcgtttgcccaatcatcccgtagcgtagtaactgtgcctgatcggctgtaatcggaacggccgctgtcacttcataaaaagtcgctttactctcctcgactggtgagaccccaatctttgtgaccacaccgtccaaaataattggcttcggtacgttccgcgtgactttgaatctaatggcttgtttgactttaacggaagaaatatctgccgtcgaaatatatagcttaacgttcactcgccgttgttgcttgattatcggtaaaattttagcgatttcagctcctgaactaacgtactttgcaccacggtaattgtctgcaacgtgtaggacgccggctttggttgccttgatcgtgtaagattttgattgtgtcgttaagctatcaatatctgctttcacggtccgtaaatcttgctcggctttcattcgtttctcagcgacttcgcttaactgatcattctttaacatggctaatttggtattgttagtctcaacactgtacttcgtatcatcaaagtcttgtaattcttctaactgcactttagctgaggacaacgaatcctgaagcgtatctatctgctgttgaatgtctgctaacgttgcagatttaacttctttttatcgtttgcgttgttggcctcctttgacttagcgacatactcattaaaaacagacccatacttggcactattggcatacttgctaccattagccacactcgcattgtataaggcttgataagcatccagattggtcttagtatttgataccacttgttgcgcggtcttcgttagcgtggctttcttagtactagcagcgctcgatttcgctgccaacatttgattctccgttaaatagatttgacgctgttttaaataactttccaatagttctcggtacccaaattcatcggtcgttggaaaaacatcactgtcagtattgatgccatctttaaaatgatccaaggctgtcacttggcgttgcaattgccgtttgctgacattatcttcgcgtaatttattgcgattaaaaacgttagtataaactaatagcttttgacccttcttcactcgcgcaccttcaactaaataattctttttgatggcactattaacagtcgcttgaatcaccggaaccgttccgatcggttgaacagttccagtaccattaataacaatctcgcgcttagctacgagtgaaaacagaatcgtaccaattaacaatagcgtcactggaataattagtaatgttgaaaaattttgaaaccgaatcccgtaaaactcgccactttctagcgggtcttttctcattattcagtttccccctcagctattgatcaagtcgtaatagtaaccatgttcattcaacaatgccgcatgggtcccctcttcagcgacccgaccatcatgcagaacgatgatatgattcgtccgctttgcaatcgacaaccggtgggcaataaaaataatcgtcttgtcagtcattgccactaaattatcgattaattgtttttcagtaattgcatccagtccactcgtcgactcatcaaatatcaagacttgagcgggtgataataacgctctcgcaatcgttaatcgttgtcgctgaccacctgatagtgtattaccattctcatctagcttagtttggtattgcatggccattttattaatatccgtatcaattaacgccaattggcaagccttcgcaatatctttctcagtaataccgctgcgattacctaatcttaaattttcttcaatggtcgctgaaaagatgtatggttcctgcgggatgtagttaatatgggtccgcaatgtatgcttatcgatgttcttaacgttgaagccgttcaatatgacatcaccactatttggttgacaaaaatcaataagcaatttaactaacgtggacttgccagagccactcatccccacaattgcaatcttatcatgttgtcgaatcgtcaaattaacatcatctaagacattttcaccgtaaccataacgatagctgaccccttgtaacttaatatcaccatttaattgactttcattatgaattggccgtgacgcctcaaattcactagcgaccaaatacacttcatttaaccggttgttagcgaccttagcgctttgaagcttagtctgcaaattaataatattctgtagtggattaacaaaataggctaataaagcattatatgtcatgagctctccccaactgataactgattatgaatgacgagattggcgcccacccatagaacaacaacttctaagactaactgtataaacagttttaatgcctgttgcaaagtatccgctttaagataggccaaactcttacgtagataatcaacaaattctgaatcaattttctgataacgttccgtctcaccattcagcgccttaacagtttcaatcccatgaagatcctcaataatggctgaactcaaaatagcattgctctccatttccttttgattcaatcgttcaaaggatttattaaaggctaagatgacaaccgcgtagattggcaacgagagtaacgtaatccaaaaaagtgtcatattctggattaccaagattgcccccataataataacgatgctgacatctaaaaacagcgaaacaattgtgctagctaacgcatcaataatcttactggcatccgtaaaccttgaaacaatttccccgtccgccgagtgggccaaaaaaactcattggcaattcaaagacgtgccgaatatagcctaaaataatttcaatcgaaagtcgttgacctaaaaccgccaataaaaaattctgggcataagtaaagatggcctgaaaggtataaaaacgattagaccaattgccaccactgccaatgtactgtgcatattattaggaatataagtatcaatcaccgcttgtaagaaatacgacccacaaatactaataatcgtgattaaaactgcagcaagcacaatattaataaccagtcggcgctgctttaataagcttggaataaatccccatagtgagcccttatcttgcttaactggcttatattccgacttcggtgcaaagaaaagggcaactccggaccattcgctttcaaaccgttcctttgacatactgataaccgcaactgttgggtccggatcagcaatcacgacatgcgttttcgaggtttttacaacgacataaaaatgctgtagatccctttatttttggtaacatgcacaatgaatggcaatggtaaatcttggacatcgaaaagactcatatctgcttgaattgctttggtttcaaaacctaacttttcggccgtttttactaatcctaatgccgtagtcccttctaaactcgttttagcaatatttcttagataggccaatgatgttgtcgaaccataatttttcaaaatcattgctaaagctgcgaccccacagtccatctcgtcaacttgcgcaacatagtttctccaatgcatacttgtactcccctcaccaattattaagtatcggtatctatttaattatgggctaacaaatattatcgtatgccaactatctattaacgtacataattttatgataaatgtcctcatcaggcttaacggttaaacatcaactagctaacattggtatttgacgttaagagaacgtttttttacttttataattttttcaacaatctggtaaaaaaataaattaaactaaatctttgttccaaataacatcatacaaggggattatttatgctacagtttgagaagttacaatattccaggttgccgcaaaaaagcttgccaaaatatctggtggttttaatcggggcggttataactttggtaaaagtgttcgacatgttgttgatgcaattggttcagttgcgggcattcgtggtattttgaaaagtattcgttaattttcttggggagatcaacaattatgaaaaaatttctagttttgcgtgaccgtgaattaaatgctatttcaggtggcgttttccatgcctatagcgcgcgtggcgttcggaataattataaaagtgctgttgggcccgccgattgggtcattagcgctgtccgaggattcatccacggatagttcaagccatcaagtttaagcactataagaaagcactcgatttatgactgggcctgcagtgctcagcctttttagtttatatgggggaattttaactatgccattaataaaagtaataatcacagccatttactacctaatagtgctctttttaatgaatcctttgactgatattatgggaataaaagacggaccctttcaattcatgttaactgaatctattatattaatcgcggtaatcattctgaatagacgatatgttaagcaacctatccactggctacccgttaacatcatgtcaatattaaggaagaatagtctgcctttgagcctagcaataatatttctacttattttctttcgaaaccacatgtatcaatttttaatctcattattactttcgttgattgtagcgataactgaagaatacgctttccgtggcatgatattcagaacgcttttagcgctaagccttaaaaatttgccacattgcaggccaccatcgcttcgatgatgactgcttcgcttatttttgcggctatgcatttggtcaaccttttatcacagcccgtatggtcagtattgtgtcaagttctctatgttattgggttaggtaggtattttacttgcagcaatctatttaaaaaccggaagtttactggctgccattagtgtccattggttgatagatttttccagtttctattctcaaggtattgacccaactcaatcacctattaacgggccaatggaagctcttctaaaagggctctttctaaatattttattcattggcattgctacgtttatcctatcctctaagcattggaagttattgagtatcctaaatattgaagataaaatagacgagtaatcatccattttgaattcctataaattattgtttgcagcactacaatttcaattatctttgaagttttgggttacgctaaaagctaggcatatcgccaactaaatttcacgtcttaacaccatgctaatatactttacgatcgagtaccgtgcttactttttagccattttaatactcataagatcataattagagccctactccaactatcttcagcgccgtattatatataatcagttttcatattcataacaaaagagctctgtcaaataacactgacagaagctctaaataatattaaaaactagttgtctctcaacaacttattcaattcccgcgactttctaaacgaagccttacacctaatttcaccgtcgagcaataactctttttctttatagtcaaaactccgcaaatgatctaaattaaccaacgagctcttatcgcatcggaaaaattgcggatacttttcttcgagcgcatttaaatttcctgggaactcagcaaccttattaatagcatggagttgtacgctgcccggtcgcaatttcgatgtactcaacaaaaccacatcatctaatgcgagtgaaaagtatcgcgttcctaacttatagttaaaaacatctttgcgctgactattagtctttttaattcgttctgtactacattgatgtccttaataatcctttgcgtaattagatcagcaggctggtctttcaaaatataatccaacggtgcacaatccgccgttccagagttacaaacgatagctcatcgtgtgttgtaatgaaaactattttagccaatggtatcgttgcccgaattcgactggctaattcaagtccagcctgtttgtcctcaccaatttccatatccaaaaagaaaaggccatcttgttgttgattcaaatctgctagaattattttttgatcatccgttgcaaccctaagctccattgcaaactcattaatcataattgtattattgacggtcttacaataattatctctttgcgcagcattatcctcgtataaataaattggaaacaatcattcttcctccaaaatcgtcaaaaatataattgtttgcttgctcttactatgaaaagcagtctatcccaaaacaagatactacgattcattgccctggctataaaagataagtttcctatttctttttcaatattttgttaagctcccgagactttctatacgaaacactgcacttaatgttatctatcgcatggtaagctcttttttttgataatcataactatcaacataatctatatttatcaatgaacttttatcacacctaaaaaattgtgagtatttattctcaaaactatttaaattacctggaaaatctgccactttattcttggcagtcagcctaatactacccggtcgttctttattagtgctcagcataataacatcattgatagggactgaaaagaaacgcgttccgattttataacctaaaatgtccttatgctgcacagtttctgtcttgagaatagtttgagttgcatcaatatccttaactatcttttgcttaatatcatcaaggccttgttctttcaaaatataatccaacggtgcaatccgtcgctccagtgtcaaaaagataactcttcatgagttgtaataaatacaatttgtgcaaaaggtaactgctgccgaatttcatctgctaaattcaacccggcctgagtttgttccccaatttccatatccaaggaagaaaaacagcccttctttagaatttacaatattattcattaactcgtgtaaatcccctgtcgccaccaccaactgcatatcatattctttaatcatgattaggtagcgtcaagaatcttgtgtaaatgaaatgccttcgtacatataatatgtatctaacttaaataaatgatgcttccaaggtgtcctggagtcctttgaaccctcggtggatccgcctcagagacttctcgttataaacattaaactgagaaaccagaaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttggggaaatgccgattcaagccttcatccaaaccaactaacccatcggccacaaacaacagcacatctttaacgccccgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtgtgtaattcccttggtatacaattgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaattccagcgtatgagtagcgttcgtaacccaaaaaccccgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctccatgattatattctttataatacttttatactctactctttgagtcctcgttatcttctaataaataaattggaaacacttatttatcctccgtaacaattaacgtcattgtgacataatctttcttggtttcaatatccatatagaaacccttctgctgatcaacaagatcccgcacattagtcagacctaagccacgattactacccttagttgaataaccagtttcaagaatctgatactgattaaaatctgaatcgataggattactaatggcaatttcagctgtgttatcaatttcattaaaagcaactgtcactattttatcagtcattttttgggcttgctcaatggcattatccaacaaattaccaataatacgtacacccactgtaacaccatgactgagaataaagtcagtgttagctatttcaatcgtcaacttaaccccgcactgtttcgcataaaaaaacttctgtacaactaacccgcgcaatatctcattcttcaaatgttgaacacttgcaatactaccatcgtttaagcttgctctgaattctttactctttgcatagtcggtcaaataatccttaatttcacttatattatcttgagtatttaaactagcaattaggttcttataatcatgtttaaattttcttaattctagatattgatgctcaacactcttaagataatcatttaattgcttattctgcaatttttcagctgctatcttttttgccaagtatatactctaatcgtttctaatgtttgccaactaataagcccaagcatcaaaacaaatgtcaacagtaaagttagttgaattgtagctgttacaccttgaaagttgctaataaataacaacatttctattgatccaaagaaagctaacaatataatgaatagatgcctatttattctttcgtcatcacttatatcaaacgagtctgtgtatcgtctcaccattttgtacacaagattgagcaccaaaaatccgataatatacatcacaataatttcaataccaatgaataaatccaaccatactccgacaagccagaaattttatcggcatctaagtagatatacagaaatcctctacttaaataagaagccaaagctaaaattactatctgactagagatcagcattaagaatacatttagattataataatttatttttggttgacacttttccttaataactgcccccaaaaccaaaattagcgacgtagtgtcatccaaaatggctcctactaaagacagcactagtaacaaaatcaacgaataaatgatacttttaatactcgtattgtggaagatgaagttatataccaagataatgccaagataaatgaaaaacgattgaataacgctatcgaagatactgatttcaaccaagctactacctctaaagtattttttattcgatcattatctaactattctaaaataatgattgttagtttactttatcagcaaaattatcattttatagtcttcttttcaagtgttgtgactctttaaaaatgccccacactccttacgccatctatacgaaatataacttaaaaacagttattcaataaatcaattaccatccccattttttaaacagtttctttacctgtttaattgcagttgcccccatctgcaaagaatacgcactactctttccacctactattttttgcatttccttattactaagttgcttcatacctttaatttgaattttcataataatcacctcgcttttaggataatgtgtttttgaagtacggaggaattatttctattaacgtacattttttaaatttaaacgtgaatcaccatgaaattccaactatgctatcaatcaatatttgatgaatgtcaaagtcactattttgaatagatcttgattactttgaacatacttagaggataaaataacattaacttaagtgtagcgctaaagaattcaagataaactcccattagtactgtacttagattaatatatttttcgtgaacaagttcaaatcatttcctctaagtaaaatttaaataatgccaaaaataccgttaataatatttattttctcttacttgtaaaggctctcaaaaataaatagattgcaattaatatcattatccacgggctaaccgcggtattgtactttaataaaacatctcctacaagaccaatcacagctaacacccctagccaaaaagaatatgctttataaaaatcgcggttcaatttcatattgtaggatttcattttagttcactccattcttaacagcacaaattctcaatttcatcattaacttagttttagacgaaaaatgattagagattgtaaatcaaaatacaaccaatttaacaatttatatttatgagtgcctataataaacattaaattccgacagaaaaaatttattatctctaggaacagggttagcacaattttgattttcaaagcatcaattaacaaaacacattaaaaaatcaaattagggaaatgcaatttttcaatcacatcccctagtagagattttataaatcattaaaaataaccacgtcacataattaagtaataataaaattgtatactatttatagtctttcataaatcactttttcaatttccataaatgtaatccctcaacttgtaaaaatgttattattccaattattcccacaactattagatacgccattattgcagaaattaattgagggcgggtaggtgtaacaagctcagaggtttctttcattaagaacaacggtaagtcatctaagaaatgtaacataattgttagcgacaaattgttagtttttaaatataaagttccccaaagcagaccacttgcaaaaacaatcagcatttgaagcataactatcgaccagggactatttacgatattgaccaagtgtgccaacgcaaaacctacaccgctaataacaatggccgtatattgcttgtttttgtgaaaactaagcttaacggaattaataggcctctgtacacactttcttctgccaatgcaataaaatagtaccgtcagtatgattcgtgcatctatcaagcgaaaagacattgagctaagtgtgctaaatcgagtaaataacaaaaataaaatgctcggtattaactggcataattgactcaaaggcttctttaagcttaaaaagcttatctttatatgccagatattttgactcaaaactattgcaacaaaaaaataattaaatccactgtcatttgtccatacttttcggaaattatcggactaattagatatggtaaaactatcaacacgataggtacaagaacaaaacaaatcgcaattttagttattatatcgttatttttcaatacaaaatccccactttaagaacatcctacttaggattctaaaattttcttttcatcattcaataattccttggcaattggatcgctgatagttttataaactgcttttgcctgatcaaacttttcgactaacagtaaaagtttgattacaacagcgctaagtgcatcttcggacctccctctgattcactgtcaataatattaaaatccgtattgttagtaaaatcgataatctttttaagctctctcaaacttgcttgttctaaactcgtaaagaaaatagtcatttctaaaactataaaagttacgtcatagggaaatttctttttactaaacttaatgtacttactggctagttccatgttttctgaatgcactagctcaatgcagtatcgttccaacaagtaattaagatactcaccttgtttcacattattttcagtgatatcaccatgaatatctttaagaatctctttttcagcttctctacatacttgtcatgttcaaacagccctaattgaatatcaattggtgaaattaagcttgtccaacgtggattatcaggttctaaagcaatgtttttttcaagagcatcgcatatcgttgttgcttattaaactttgcatattctccctttgttaatccattgttcatgagttctaaatcagtgtcaaatttttcactaatttttctgttcttttagttctaggttcttcatgcacatatccaaaataataaagggtctccgttttctttacaaaacgttccggacgaacatatgttgggcgatccggttgcatctgctttactgtgcaaattttgtcttgatttgggaatcttttatcaacttcatataaaaaggattttatttcttctgaattatattctttagaaaatatttcatcagaatctacaaacaaaacccaagtatcatttggaacaaaggttagacatttatttctcatggctgcataatcttctttccagtctacatgctttattaacacactgttataattactttctacaattgcaacagtgttatcgctagagcctgtatcaaccattattatttgatcacagatgttcacaattgattctagcgtttgcagtatccgcctttcttgatttttaaccattattaatccaataatcggttcataatcacactgatgcttccttcagcctgaaattgctaaatgaaacatttccccgttctttaaatttaatcatgatacaacaccgtcccacctaattgttctttctgaatacaatcaaataatgatgaaccaatcatttcactattgactagtccatcattattttgctaattcctaatagctgttatttttaacctaaaccatgccatgcactcgaagttccctctgctacctttcccagcaatgtaaggctcttgtaccaccatgtcttagaatagttttttccaccttcaacggtagtcaaatcttttctgccatttcgatacctaacccggcaattttatctaaacttttcataattgcatttcctccttaaagcattcaacttttgataaacatctaagtcccgtttgcatttcacgatatacatttgaaatgcaactttaaattttccatttcaaacatccccttcagtgaatatcatcaaatcgcattaaatgccaatgcaattccaaacgcaaccatcaaaataccaaaagataatcctgaccagacacccaacgcaataaagggtgaagtacttttgttgccaacccttttttacctgtttaaatgctaaataggcagtataaatttgccaaatagcaaaacatataataataaatcctgtaattctttcaagcatcttcccactgctttctaaacaacaattatttttaatatagactcacacacaagaaatcgctttcattcaattcaatcgaactgcttgatatcactctctctacgcttttaatataccgcttagtcgaatcattgtacgatatttttataaacgtaatatttttagatattattgtacaataattcatcgataccacgaaaatagacgtttaaccaacaattaaagtcaacacgcaaagattccagtctagcttcgccattcaatctcctaggctcaaaattatggtatccaagcggccattaatttccgccaaaatctaggtgttgaatttcttcttctccagtccgatgtgttgtgcccatctgaccggcaagatgaatagctttttataaccggtgtatgagagatcatgttagaaccgactaagcaattaccatgacgcctgagcccatttaacttcgcgcccagaccaccacaccgcaaaactaacgaaataccaacgacttgatttgcgaacacatttccaaaaagaactactttaaacgacctcaacaatcaaggaattatcacattagtcatagatttaaataatcgccacgtaagagcttgaaatgaaaaaggccaagtgaagttttctttggtaaaatattgcacttaatttaacaattcgtcatagcaaaaataatcccattaatgttatgggatcgtcagacattcaactttcaagttacgttaaatcgattaaatagtacgataacaaatttaaaataatttttttaaattgtagcgtatattaataagtgcattaaaaatacgtagcgcatagaacccatttttaactgctacagtaaagggagaggtatgactgtgaacaaaatgattaaggatttggatgtagtagatgcatttgcacctatttctaataataagttgaacggggttgttggggaggcgcttggaaaaatttctggtctagtttaagaaaaggattttatgatggcgaagctggcagagcaatccgtcgttaataaatggacttaaattaaggagcgtatattatgaaaattaaattaactgttttaaatgaatttgaagaattaactgctgacgctgaaaagaatatttctggtggccgtcggagtcgtaaaaatggaattggatacgctattggttatgcgtttggcgcggttgaacgggccgtgcttggtggttcaagggattataataagtgatagaaattgatttcaaagaaaaatattacccgctagtgttagtgctctttgtggctggttatatgggtgcgatctttcttaatatttattttgattgggttagcaatgcttacagccggaataattagtttagtcatgctatatggtttttctaacttaaaactgtttttcaaccgttaccctcgccaaagtggcgcatagtagttaagtatgtgcttttattgcttgttctggaagtcactgcgattgtggttatagctatcattaattcgcatgctttattgtcatttcacaatacaacattgacaactagttcaactgggcgagattatcctttaattgaaagagtatggatagccttcacgctactagtatcactagttggtgaggaagtcggaatggcctctatttcacttccgttgattcgcttattatcgcaaacacaactaaaaaaatatgcgtggccgattatcaatgtattggggtgcatcgtatttgcgtgtctgcaccttccacattatcatttcaactggatttatcctttaatcgtcggtattacgcgttatccaataactgcttcatggcgatctgccaataattactttacggagcggcatctatgtccattggatctcagacgccgttttaattattggcacattaatttaaatataaaaggtaaggcacacgttaatgctcaataaaacaataaacataattaagaaatacccagtgagaagcttgctggtagcgcttattgtcgttttcgcaatctatgtgattagtgatccttcaatcattagctcatttaatcaagggcttagtgatggggctgctgggcgatagcggattataaatgattattcaaagctagaaagaaaaatacgagtaagtttgctatagtccccttaaggtaaaagcatcattcatctgtcgatttaatcggggttgatgtaagactgacgtttactttttcatcctatgaaaaaatagcccaaaatctcctaacgaggttttgggctattttggcgaataaatctgccattattttgtttttcaaaaatttaaacataacctattctaggcatgtctacctgtgcaaaatttcatataaggggccttaatatatgctgtttcagtattatttttatgaacagctacaaagccattactatctggaaagtctattttaatagtcccttctttacctactttatattcatagacattactatctaaaagtttcgaaccattagaaaattcaaaagatataatttcttccatatttatcaagctccttctgatatcacctatccaccaattatagctttcggaaccaacgtcgtcttctttttataatagttactccccaccatatccttaccatccgttacctttttcattttagcataatccaagattcttcagtcaattcttaattaccttccacacttttaatataacgcctacccgatttattggacgatatttctacaaccgtcatatttttagctattctcgtacaacccaccaccaacaccacgacagtaagtcaactcactaatgtaccaccctcgctcattccgttaaatcacacaggggttcaaaaaaacgccgtagtccatactacggcgtccaagcggctcttaacttccgcccaatctatgtggttaatgctcttctatgatgctatgtgttgcagtcacctgaccggcacgatgaatggcattctttaagacgaacggggcaatcatcgtcaccacaatgatgaccaaaataatatccgaatagtaatcgtttgatagtaagtgcgctgaaaacccaatttgtgccgttatcaatgccatttcaccacgcgaaatcataccggcaccgactaagtaattactatggcgactgaacccatttaacttcgcgcccagtccacaaccccacaacttagttaacacaccgagcaccgtcatgaccacgatgaacggtagcgattgccagacccctttgaacgtcatatttaaacccacactgacgaagaataatggaataaacgtcgtgtagcccactggttcaatactaacgtccaccacgtgttggtaatcagtagttttgtgcaattgcgactccggcgaagaaagcacctatagcaccactcaagcccactagttctgccaaccatgccaacgctaaacaaataataatcgccataatagttggactggcagccatcaacagatgatcactcaagcgcatcagatacggggcaacccacttaatcacgatgaagacccctatgaagaagccaacctgttccaagagcacgataccgagattagtctgggcaacgccactctgaccacccatcattgcaatcatgatactcaacagaatcaccccgataatgtcgtcagcgaccgctgccctagaatcgtggctccttccttagtatccaacactttaaattcctttagtacctccacggaaatcgaaaccgacgtggctgaaaagatgacaccgataaacagtgattcaaaccagctaaactgaaagaagcgactcgcaagccccataataatgactggaaagatcactccaataatagccacgataatggcggggcgtaaatacttacgtaaaagtgctaagttgctttccagtccaccgataaacatcagtaccacgaccccaatatctgagaacgtttgaactaaagtcgttaaatggacccagttaagtagtgccagccctaatatcaccccgaccagaatctcaccaatcacggcgggaatccccgcacggtgagcaaagtgcccagcgagggttgtcgccaaaatcaacaaacaaagtattcccaaaaaaatccatgtgctcacccatccatcaaaagtcttaccatctatcatacacctttagtcctggctcatcttgtaagcatgggcgttctggaagcggcgcgcatagtgccagcccaagccgatcagtagaccaataatggcgggaagtgcccaatcaaatcctagtttagctaatggtaagtagcgttgatcccatgcaagaatcgtttgaacccatcctaaccgagtaatcagggctggtgcagcacctaggaccatcaatgaacgctggaatcaaagttaacgccgtcgtccatcgataaacgagcggatcacgatgaaatagcggtgaggcaatcgctaagataatcagtgtaatcgccaacggatacaggaacatcagcatcggcgtcgaccatgcaataatttgatccaacccaatattagcgatgagaaatgaggccccacaggccaagcggttccaagcgcgataactgattttaggaaatttagcgtgcaaggcttccgcaaacgacgtcgccaaacccactgccgttgtcagacacgtcaaggtcgccataatcgctaaaacaatcgcacccggcgtgcccataaaagcattggcaatctgaccaaaggcaatgccaccatccgcagacaacttaaattgcgataacgacgtcgcgccaatccagatcaggccaagataaatgactgcttctaaactaatactcaacaaactagacttggcggccgtcttagcaatcgctctgggcatcccgttgaccaaggccccgaatcgtggtgacaactgcaattccgaacaacaaggcagctaacgcatccatcgtattatacccttgcaaaaagccgttcaagaacgcgccgtgttggtaggccgcggtcggtgtcgcattcgtggtccctaacggccggctgaaggcaatcccaaaaattaaggcgagcaaaatcagaaaagctgggtttaacaatttaccgatcgtatcgacgatccgggtgggcctacgagctgcccagtaagtgatactgaagaaaatcaatgagtaagctaataaataccactgtgcctgtgccgaactcacatggctagcgatgccaatttgaaacggcgtagtggctgtccgcggcgtcgcgaacaagggtcccaaagtcgcacaagtcagtaccataaaaatcgtcgcgtagcgtttaccaattggccgcgctagctcataaatcccactactgtgcgtcacactgatggcgataattccctaacagtggcaatagtgtccctgtcagcaagaatccccaaccagctgtcaaccaattggcccccgctagctgccctaagtgaattgggaaaatcaagttgccagccccaaaaaacatcccaaagagcattgatccaataatgatgtaatgtttgattgttaattttcgcgttatttgcatagtcgtctctcctccgttaagcgtcgttctcatcaaccagtttgaacaatcactagtaagagcactcgatacaaaccaccatcactacttgttaagcgcattgtctccatcctctcaactgccatgggactaaaaaagcgtccttacaaaatcatcaattgattttgtaaggacgctaacgcgtggtaccaccttaattcgtcacgaaccgcagctcgtcacctttgcgcgtacggccaattaccaacaccgatgacgggtttccccaaacagtaatgttaactgacgatacgttggcccgttaatggggcacccagctcaacactccagctcgtcgcattagcagttctcaggctactttccagccaggctcaccaccgcttcacaccatccagcggctcgcttaagattaccctgactttactctcctgatcatcacgtttagtctcatttatttttaatatttgcaatcataaactcattgcgtagtcttgtcaactgtttcgctaaaaataatcatccgagttaatccgataatgcccactgccgaatcgcagctgcgaccccgttcgcatcattagtagccgtcacgtgatcagcgtgtgccttagcaatatcactgccattgcccatcgcgacagctgttccggcgaaagcaaacattggcagatcattctgttcgtctcccagtgccatcacttcgtccggttgtatttccagagctgccgctaaatcctgaactgcccgccccttgttgacaccagtatgcatcagttccaagaagttagttgccgcacgtaccacgtacaggtcccgacccgaaaaagtcgtcttaacttgcgcttctacggcatcgagttgcgggccttcacctacaaagacccccttggcaatttgaaaatcagctggtaaatcgtcagggtctcgaatcaacagcccagctttgttttcccacgcctgtacaactgtgacccagttaacatcgcggtcagctgtatagatcgtactgtccgcatcgagcacgttaaagggcacgtgatgttgttttccaaacgcggttaattgccgatagtgcgcattatccactaaatgtttggcgacgatccggccagcaatgctctcgattacagcaccgttatacgtaatcacgtactggtcatcaccagcaaggcctaacgcatctaaataatgttgcgccccagcaagtggccggccggtacacaaaaccaccttaatcccttggtcgtgggcttccttaactgccgcaatcgtacttggtaataattgcccctttgaatccagaagcgtgtcatcaatatcaatcgcaattaatttaattgtcatgggttttcgttcctttcaactgcgaatacggttacaattaagtcatgccaccgctcatcgcgaactataattctaatatagcatagcgcgtcagccatcaaggttgatttttgaaaggaagcggtgcgattttacaaaatcttgaagcgaggtttagtgatgaaaatcttacacgagacggtccagacaattccccgcctcccctttaaatattacgaacatgatccattgactgatatcaacgttgccccacactggcaccaagggattgagttaaattatctcgtcagcggtacgaccttaaaattcgtcaccgatggacagacgaatgaatatcggcctggtgacctttggactactaatcgacgcgtggttcacagcgctagtgggcccaccgaagttgactgggtagagttcggcatcatcattgacgacgatttcttacaaactcaaattccggcaagtgcgaactggctaattgattgattgaattgaacggcgcggcctcatcgaaaactcacccacaagcctacgccgatgtccgccaacaattagtcacgattcacgacctgttgacgaccccacgaccgatctgctgagattacaaattctcagccacttttaccagttacttgtcactctgggtcaaacgtttaccgttcctctgactgcaacaacggtcagccctaacttgacattaacggatacggtcatgactgccatcaatcaacattacgctgagcccatcgatggtaatacccttgccgagcaatttcacgtttcgttgaccactttgaatcagcaattcaatgcaaacgttcaactatccgttaaccgatacttacgactgatccgattgatgaacgcccgtcgcctcctgttagagaccgaccataagattgaatatattgccatgcaatgcggctttccgaatagtaagacgttcaatcggaattttaaatcttggaagggtatgacgccctcaccgactatcgtcaagcctatgcccggtatcaccgaattgatactagttgcctctaaaaatgtcccttcgtggtctgaatttcgtggtaagctacggctatcaattaaacgacgggagattttaaccatgattaaattaatggcaactgatatggatggcagctttttgcgtgacgatatgacttacgacgaagctcaatttgcactgctttatcaacaattacaactacggggcgtacggttcgtgattgcaagcggcaatcaatatttccaactcaagtccttcttcaaggactatcctgagatgatctaccttgctgaaaatggggcttatatccgcgatgccgaccacgtttacgcacttaacgcctttcagccagacgcaatccagacgattctgaataagattcaaaccatcccggatttaaagctactggtttgcggtgccaaaagtgcctacaccctaacgaccactaatcctgagcacgtggcacaaataacgcgacattattatcatcacttagccgtcgttgaaagttacgaccagcttgatgatgacattatgaagttcgccatcacatgtccaccagaacgcaccacagcgatcgtgacgcaactacgcgagttactaacgggtatcgccgaaccaaccagcagtggtcatggcgacatcgacattatccaacccggcatgaataaggcggctggcttagcgcaactcggacaggttctcggaatcgacctcgcagacatggctgcatttggcgatgggggcaatgacctagaaatgctccgggaggtcggctgcggcgttgccatggcgaatgctcaaccagccgtgacagccgtagccaacgccacgacaggtacaaaccaagaacaaggcgtcttacagtggatcaaaaactggttggaggcgtaagccatgcagccacggttgaccaccaccatcagtattcttagcctctccactgtaacaggcatcactaccgttattacatgggaatcattccccagctcaaacggacctttcccaccgtcccgactacgctgattgaatggctcgtcaccatcgccaactgtagcgcattgattactttgttactcaacccccgattaacaagccggtggggattacggccaatcgtgattagtggactcttgatcagcgccatcatgggactgattcccgctatcacgactaactttaccgtaatcatggtcagtcggctcggattaggattaggcgtcggcctcttttcaccacatgccatcagtttgttgacccacagctttaccggtgatttacgggcccgactgttaggttaccagacgggcctctcagccctaggtaacgcgatattgctaggattagcgggcccgctgatcagtctcagttggcacgccgtcttttggctatacgggctactggtgattgttgctgggggcgtggcgtggttcgtaccggaacccactgttccatcaacaacgactaatcacgcacgcactgaaaagacacaactaccacggcaccagttgacgttactaggacttacctttatcacctatctactcatctggggcgttcaattaaagctgccgagttactttagcgcccgtcattttggtaacgctgccactatcaacttaaccttagcagccatgaacatcggtggcttgctggctggtctcacctttggctatctataccgctatttacaccggttcaccttaaccttaggctatgccggagcagctatttcagtcttagtattatggttggcatccaatgcaactgtggctattggcgctgccgtatttttcaactttatttactcgtacaccgggccatatttggtcttcactagcaatactggcctggataccattcaagtcaacgtcctgagtagctacctgacgattgccaccattatcagcgctttctttgcgccactggtctggaacagtctcggccaacttgggccacagacgctcaccgccaacgttctcatttggattatgctcattttaggtggcttagccttgattaccggcagccatcatccacgaaaggaagtttaattaatgaccaataataacgatcgtcttcatactggcgaactctacttacctaacgaccctgaacttgaaaaacgccaatttggctatctcgatcagctctatgatttcaaccaaactcggcccagcgaactaaccaagcgccaaattctacttagcaagatgttcgcagaaatcggcccgaagtgttacatcgaaccaccgtttcacagtaactttggtggacaccatgtccactttggcaaggggtttacgccaattttaacctaacactggtagatgatacccatatttacgttggcgactatacgatgttcggccccaacgtgacaattgcaaccgcgggccatccgattttgccatcattgcgcgaacaagcttatcagtacaatatgccagttcatatcggccgtaactgttggttcggcgcgggtgccatcgtactacccggtattacgattggcgacaatgtcgtcgttggcgctggtagcatcgtgaccaaagacttacccgataacgtcgtcgccgtggggaatcccgcccatatcttgcgacacattaatgatcacgaccgtcagtactactttaaagaccgccagattgatcctagcttgttaaattagtggtttcaaaaaatcagttcatcgcattctctgcctttatcacggcagaatacgacggactgatttttaatatgcgtcaaaataattaattctcgttcattttttgccaacaccttagcaacgttgatcgttggcaacgccacagttgggtattcatttgataactgctatcctcaacaacatagccttaagtttagaactgccattacaccacctaactatttatattatattcgagtaacccatcattactgattgttttatgatacgaacgtctgctcaacctgactaccgccgtaattaagatcactatctgagctgtagctcaaataaagtattattttacaatataaactttaaaaatccttggcttaccaccaaccataaattgaacgacatccttttcccaaaagggtaaaatatcatcctcaaagctgtccattattaacctttttaatttaggatttttattcatgaaaaaatcatatttatttattattactgcaattttttgattgggtatccagctcaagtctgtcatccaatctgaataggcagcaaagcccgcataatctggcattttaaatttttacccataaaattcagatattgacgaaacgtgcgaacttttttgcctggtactgtaacaacaaaataatttaaatcattcaatcgttctttcaacgacacaagctcaactttatcgacaaatgaaattttattttccattattacctcacttaactttccgaatctaaaattaaagtgtaatacataaaagactcccccaaaagaccatcgaggcctatttcccctacccatactcaccttggaaacacggattaggcgtaaatccaaaccggtaaattcgcgattttattttcaaaagataatttatgcgattcttaattattactgaaatctaatccattcaagatgttttgaaccaatacgcatggtagacacttacttatcaggtatcatagatggttattttattaactgatccactatttaacgtacgtgttacacttgttttgagaacccggagtagaaaaattagtggctaatttgattataaaaatcgcctttaatttctaacattcaatgcgatatcttcatttttattttcagatagcagaataaggcttctaccaaattgctcaatcaatcctaactcactataaatataaaatttacatctatgctttctatcaggattatcgtcaatctccatatcaatctctatttttacacgcccagaattatcggccggtaaaaagcttaaagaataaatgctggtgtaaaatttccttctttttcaccaaattccacataaatttcttctttagcgtcgaaagaatatgcaataattttctcgccaatttcttttaaatctgtatcttgtacatagcacagttgatggattgttacaaattttgatttcgcattaatacttagttctaataaattattatcttcccaattttttgatatttctaaattactcatattttctcctctcgtattacttattctcacattggatgaaacgatacgacgaaaccgttgtccccatatgcgactcgatatacttttccattaatgttatagtccgcctatgctgtttacatacccctttaaaaataactttcagcaatatcaatgtcatgtgccatttctaattctggaaactttttatccaatttccttaaacaatcaataaacttttgacttttcaaattggcagaaatatcctcaaaaacttcactgatccaatataagtccgtccgccatcacaatcttctaaatactttattgtaatatcctcattaagagacaaaagttcagtcactttgttccaacatttttcaataccacaatcatcatccacatttaatttttttccttcaacctgtccaaacttgcggacttatcccaagtgaccgcgcaacggtctattttgcacatctcttactcaccaagagaatatggcactaacgagaatcggaatcagttaatttgacattttagataataactctgttataacaaactatagatcagatgctttttccttgaatttattatatattttcataaattcttctttttgagttctttatagatttgtacgtatttagcatttcatctaagtagttccagtattccctgggtgcgtctgtttttggaacaggattttcttctgagtctcttctagttccactaaaatctccatccgttaaatgatcagcaacattattatttacacttttcttttgaacaggcgtcaactcttcttcaatactttttggagttttatctccactcattttcttgacctcatataaacatcattaatacccaactagattcgttagaaatgatgcccttattttcataccagtaatcgtctaaaaagtccagaacgcgtaatttcatcaacattctggagcttcaaccgacttattttgtttgcttattgaatcgttgtcgtctccaaacaaacaacaggacatagataacggtaatcaccaaattaccaactaaactagttatcagttctcaaatgccgtcaccaagtacccgcacaaagactaaccggacgataaaataccaacatgtgttgttgcctccctcataactcaacttttctataaaataaccgatactcggcatttaatccttgtcgaatatcggttattttaatctgactaattcatattacttattagcccggtgcttccccaaacaaataaaccatagtaaatcaaactgaataacaagctaccgactaatgacgatactaggccatgtgttgtagtttgtgtcatccaagctaagattgctcgaacggcaaagtaagctactggaataatgacatctactaaattagtttgggtcctttttctcaaccaataactccataatcctaatcccagcgtaattcctatgatgactgctcaaataatgataatcattgtcatttttactatttttgaatacctttacgaggtccaacatcaccctttccattgccatacctatcactgtcttatccagcaaatcatggatatggtccagaacatttaaaagctgcaaattttgataatagctaagaattttcagacttgtcataagtgattagcacaatggtataccatactaatcgtggaacatgggactaacaaaagccacagttgaaccagaaactcatacccaaggaccaaccgatgcgctcctgaaccatcactggtcttcaagttatccaaagccatctggaatgggctaatccagctaaaatcctgattaagaacgagttgaaagtattgtacttgatttaataactcagggattcttgtttttaaaatggatctttatttattatttcagctttaagacctttactagcaataattattggtgctgtgtcaaaatcttcagcattaatcttaaatatataatttccttcttctacttggtatttatcgatgactttccacatttctttgcctgctaccaactctataaatggcttagaattatttaagttccaatacagcaaactagacagataataaggtttcctgaaatcaatgttaatagcaaactcatcatatgaagtatctattctacctgctacaacaatatctccaccatccacactagcaaattcaaaatccatccataaacatttttttaaataattgttaacctttaatatttctgaattgatttcttctatattcatatttctctactctttctctatttaccgacaaggatatgggtatttcttagcagctttaggattaaaatctggattaggcttaccacctttatggaactcttttagtacgctctcatgccaccaattctcatcaacatccatatattctacctcacttctttgctttcctgagacaggcacagagttcagggatgtccaagccacaccgctaagcataaacacttcttaccggtaacggcaactttccccgtaatcatggtataaatatcattatacctaactagattcgtcaaaaacgaaataatgcctttattaataccgcaatagtctaaaaagtccagcacgcgtaatttcatcaacattctggatcttcagccgacctattttgtttgcttttgcttattgaatcgttgtcgtcccccaacaaacagtagggcataaacaacggtaatcaccaaattaccaactggtatgacactaccaactaaattcaacttattgcgtttccctaatgcataactccaatagcccaagccaatcgtgatttaccccgtaatcaatccaatcacaataaataccaacatatgtcgttcctaccctcataactcaacttgtctaaacttttctataaaataaccgatactcggcaattaatccttgtcgaatatcggttattttatttttatctgactaatccatattacttattagtccggtacttccccaagcaaataaaccatagtaaaccaaactgaataacaagctaccgactaatgacgatactaacccatgtgtcgtattttgtgtcgtcacaactaaaactgtccgaacgacaaagtaagctattggaatgatagtgccaacaaaattagattgattcctttttccaagtaaataactccagaatcctaagcccagcgtaattcctatgattactactccaatgattataatcgttgccatttttcaatctccaatcattttttgctattttcatactcttttacaatatctaaaaatcatttctccaagaatattctttcgcatagtctaaacatgatttgccaaatccatctttcaaattgtaatctgatcctttattcagcagcaactgatacatttctttattgtccgaagttggcaaattatttattgtaatagcatatttcaatggaattgcattgtatttgtctgtcgcatttacattcactccatgtttaatgaaaagatttgttatttccatttcatattctatagtaggtcgcaaaacacaaaaataaaataaatgaagtgcatttcgtttttctttttgtgtagcataattcacatctattccttcagcaaataagaactttattatttgaagtttttcttctggatttttatcattagtaactgccatacataataaattcaaatccaagtttccactaatcacattaatatttccttcataaaaatttttaaagtcttgaagcgtgccatcccttactgcatcaaaaacatttaatattttcattgtttttcttctcccgtttttttattgttcatatttatgatttctattagctgaaggtgtctcaaatccaaaattatttgggttagcttgaaactccttcaatattttcttaaaaataaccggtacccggcaattatttctcatcggataccagttatttctactgactaattcattttacccattagccagacgctcctccaaataaataagtcatagtaaatcagggagtttattctataaggaaagtccgtgcatacaagccttaactatcactagaattcaaactatcaaagatgctttgaaatactggccacggcaaacacttgcccatcagccatcaatggatggctctacagatattaattagcccactatttaagaatggctcgagggtgttacacttgatttgacaattcgagattgaactcaagtttaaaattcaggaaaatatcaattctcaaataagctagattcttaacattacttcatcaccactagctaccggagaccctaacctaaaacagtgcgatgtatgttattttagttattcatcttcataaattactgttcctatgtaattaatacgatagttctcacctgtagcaattttcctaacaacttgttctttatcatagctataatcatacaacaaaataatcgcattataactatcctcttgatctttaaattgagaactcaactgattatcaaatgacattgtcacttactctattacttgatgaactgccgttaaccaattctgccaaacctcagtctgaatacgttggctgtgtggcagatacgctgccttccagagattacaactcaatttacgtacaggatgcgtatgcagtgcattgtccggaaattcaatttcaaaataatcccttaccattaagaaggccttcaaaatatctaatagctttttattaccagagcatctcgaaaacttccccttccaatagcgatattcttcattattttcactgatagctctattttgctgcaaaaaattcacccaattcactatcatcactaacctgataataatgctgtaaaaatttcacaaacgcataatacgactgtgtcaagtccaccttttccagactggtccccatcggaatttctggtcgtggcgctggcaaaaccttggcaattggaaattgattttgccgaaaacccttttcctttggattaggcaatgattgccccgttttaagaaagggcgattcattgactggcacaacattaggattcgtaatccaattaacagctgcgacccaattttgccacacgggttcctgatttcgttgagattctgtcatctcacaaattattctaatgttatacgtcaagcttcctgatactggtgtcgttgctgcgatatccggcaaatactcattcacaaactgcttgacagcttgaaaactctcaaacacagtgtgattttcgttgctcacgtcgccaaagaaagtatgccagtcctccgcaattgcctgatcaaacaattccccgcatcatcactccataacgtgacgctccccaataaacttccgaggctatcatctttgcttgcccaataataagaatccaaaaactcagacattgaaaagtaactttcctgttcactcaatctttttgtcaaggtaatttcactccattcttgatataccaagaaaccttatgcattccatctttcataacaggaactggtcggctgttaataccaccatcagttattctaccatcacggactctaagcaaagtatcatcgtgtccccgtgaccaagttgtaaccggtagcggcatctgattatggcataaatatcattatacctaactagatccgttagacatgaaatgataccttgattaataccggtaacagtctaaaaagtccagaacgcgtaattccatcaacgttctggatcttcaaccgaactattttgtttgcttttgcctattgaatcgttgtcgtccccaaacaaacaacaggacatagatagcggtaatccaccaaattaccgactaaactggttatcaattctcgaacgccttcgcccaatactagcacaaaaactaaccggacgataaaataaccaactggtatgacactaccaactaaattcgacttgttacgcttccctaaaatatagctccaataacccaagccaattgtgattaccgccgtaatcaatccaattacaataaataccagcatgtattatttcctctctcataactcaacttgtctaagattttctataaaataaccgaacctactgtctgattcttgattgttttattcttcattatcaagtataaagaatattttcttctcccccatataaaaataaaatcaccgttttgaatatcattgatagaagtaaccgttacatttacaatgttcctactaactgaattgattttaatttcaataaaaagattattccttattaataaatctattcaagatgctttgaatcaccaaccacagcaaatacctggttatcaaagggcgggcatggatattctaccaagtcttgattaaatcgatcattgtttaagaataggccgagcgttcgccctccaaagatgctagcagttttgttccagctttcctacatttgttccattcactagcatccttaagtgtttcttcacaccaaagcgccttattcttactcatatcctctaatttttcatcaatgttcaggaattgctgatactgttttgtagttatccaagcattttcaaataattcctttgcataatttaatgtaatatcagaaaaatccgaagctagttcatcagcaaccgaaaaaccttttaattgttttatctgattctctagagacattgaaaactcttgaagattctcgataaccctgtcatataacattgttaacttttctacgtcttcagtcatcatttcacaaccttcccattcgtataaatcctaataattccatgttctggagaagaaactttataataaggtgaatcgccatggtgacacaccagggtgatattgaatataccttgagcttcctttaatttcttctggagggttcatgctaaatcttctaccattattttatttttcgcgactttacttaagaagtaaccaatattcagcaatcatccactttgtgcgctcttactcaacacaagaatatggtaccaacgagaactagaatcaattaattggggagctcatactcaaagattattcgttgttttctgaccattattagttctcaaactatcctaaacacctcgagccagtagctacatcaaattcttagttactaattagcaataagattgctaccagactttgattaactagattacttgcttagtctgaaagtgttgtacttgatctggcagttcagaatacctataaaggggatgttttcaatatttcactaatttctatttctccagctttcttatagttttcacctactatacttaacagacttaatttttatcaaaaataatttttctttgaactttgatttggtaaaatatgcgttctcatatatcctattgctaacgtatctgtaatagaactaataacccaatatgttatttcaaaagattatctgtcacattatgcttattttccgttcctcgctcactatacacaaaatggtatcgctgaccatccgaataaatataaaaaccatcttcacttccatgcttgttttccaagaaattgtattctttaatattaatatttcccagcctggaaactctttctgatatataaattttcaaatcttccgttgatagtttaaacattacaccactcctattttgttattaattcaatatatcctctcttaacaagttcttcaatagacataggaagtttgttttgaatgcccccacctggcataccaaaccaaggcgcaacttttgctcgttcaacatttggaattttcttaaaaagataaccaacaatgaatcatcgttggttacctttaaggtttagatttctcttatattgttatttttaaattttattttaatcttctttaatataattttctgcattatcaatgaaaaagttaatttcaggtcaggaaacttttggtcaagttctcttaaacaagctataaatttcttactttgcaatttttcggaaacatcatcaaaaacttcgcttatccaagaaacttcttctttagaacaattcttcaaataattaatcgtttcgtcttcattttcagataatatatttgttaacttttcccaatttctctcaataccaaaatcatcatttggatttaactttcttctatcctctaaattttctttaatttgatcagatatattcatgaattttcctccttataatattttactaaatagataaacttagggctgtctggtaccatctggaaaaattgtaccaatctttccatttgtttttattactcctactctcactccattaacctcaccaaatatagtttctccatcttttgcttttgcaaattctggaaagacttgctacttgctgtccagcactctcaatatcttttgctgtccagttttccggaaaccatgattgacctgtaccagcacgtttagtttgacttttatgtttcggtacattcccaactcttacgccatttggatacgtttttcgatattcacttccaaaccatttttcttaaaaagtcaatattatcttgcccatgccctccacctttcatcattgaaatttttcctgtttttggatctatagtaaaattacctaaattagcatgctctaatctttctttagaaatttcaattttcactttaggtccactggctttcttagccttatggtcctttttaccttattcttagcctttcgttttgcagtcttagctttagcactcttccgcttgcccgacttctttttagtaccaccctttttccgtgcgtacgaagccttcctagccttgctcgcagctttttcttgttgtatcgcttctgctgcttcttggtcgttttatgcttcgtaacttgggaagtcttttgaggctttgcgtgcttggctgccttctctcgctcaagcttagcttttgctttggataactgtgtgccagcgcgatgggttgcctcatgctttgcttgacctgttgctcggatatcttttgcgtgcttggccttttgggctttacgagcctcttcagctgcctttttcgcagtctttctggcgggctttcgtttagctagtttctcggccgctcgctttgtcgccagtttagttgctcgggcggcccgtttgatccggccaccattcttcgcaactttctcggccttcttagcagttgccagaaccttcgcggcctttgctaacttagcgactttcgagacaggcacaaagttcaaggctgtccaagccgctcctaccaaccgcgagcgcttcttaccggtagcggcatcttttcccgtaatcatggtataaatatcattatacccaactagatccgtcaaaagcgaaatgatgcctttactgataccggtcttacgactaagcgtggcaattacagcactacctttggatgcatgctttttcgaagattttttcttgttagacttgccgtgcttcttagatgatttcttcttactggatttaccatgtttcttggaagacttcttcttactggacttgccatgtttcttggaagactttttcttattggacttaccatgcttcttagaagacttcttcttgtgcgacttgccgtgtttcttggaagactttttcttattggacttgccgtgcttcttggaagacttcttcttgtgcgacttgccgtgtttcttggaagactttttcttattggacttgccgtgcttcttggaagacttcttcttattggacttgccatgtttcttagaagattttttcttgtgcgacttgccatgcttcttggccgctttcttcttgtgcgacttcttatgtttcttggccgctttcttcttgtgtgactttttgtgcttcttcgaccgctttctttttatgggccttcttatgtttcttagcggccttcttcttatgcgactttttatgacgctttggcgtttttttcttatgccttaccgcaactttccgccgatgcggtgctttacggtggacgactctgcgcttagctttgcgatgtgcacgatgagacttcttggcgtgaccactagcgctatgtcgcaccttatgcttccgagtgtgggtcacaccacggcgatgtgcggagactgtgtcgaccgagctggaaaaagccgtgaaaactagaacaaacaccattaggccaatgaggatttttttaagaacctggcgtaattttatcatattagtcacgccctcgtttcttaataaccatcgtaatcgccacagtgagtagcaacaaacccactcctagccagaccaaccaggtcgcgaccgcggagttcgttttaggcaaaatttggttcaagattggatgttgcttcttgaacgccgatcgttgcttatcacgacttgccgctgcagcacttgctgaggttacacttggaactgacgcacttgccgtcgtagcccgcgactgccgtggcgctgtagaactggtagcggctacgacagttgctcggttagccttggtcgttggcgtggatgaagcccgcttcgtattagctttagttggtactgacgattgactagtgaccgtgctagagcctactgcttgactgctaccattaacactattcgactgagtttggctggaacgagctgcggcctgtttatccgcgtcagccgaatcaccggtcgtacttgagcttgatgagctttctgaacgactattttcacttgagctagttgaatgacttgattggctcgcatcactaatacttgccgaactagtcgaatggtcggccgcacttgaagctgtacggctactatcactactattagtgctcgactcactggcagcactctcagagctggtcgtcgcactacttgctggtgccgcagtcacatcattgttttcggctgcccacgcatagcctgaacccaatgtataggccattcccttatcaccatcataggtatctaggtaaaagccgtcaccatcggccccaccatcaacttcaacggttgtatctggcgacacataaaggttctgttccccttgatcagcccgcagcgttccttcatataacagtttgccattttgagtcagacgcgcccgggtattcgtagcttgcgcaaggggcgttgctgcgctgcttggattgttgttcggcgaaaccccttcatcattactgaataccggatcattgactggcacgccttcctcaaaagaagcgtcctcacccaagacaaccggcgtggaattgggttctgcaatcaatgcttgtaccgctgcactcgtatcactattgagactgctcgaagtttgggcgctgcccagtgcactacttgtgttttgatcctcagtaaatggtgacttgaaacccagcccactgtcagtaagttgttccagtggtcgtatcaccggtattggttgtttcaccgtcagttttaccgtcagtagtttgactagtgcttgatgccacactactatccgtctttgaatcagcacttgcactagtacccgactggcttgtagcctcagtgtcgccttgactattcgctgaacttgcatcgacactactggacgcgttcgttgcgttggtcgaactaccagctgttgattcattagtctcagtttggtcagtcgctgtcgtacttgtcgactgattactaccagactgactagtatcagtcgttgtcttggactcagtcgttgctgcttgactcggattaatttctttttgtgcggtaactttcaacccattcaataatcctaagtcgtattgttcgccagtcaccattgatttcaacccgtcaaccgtgttggtctgctggctcttagtgccattcgcgttagtcaccgtggtcactgtcttgagctgaccacttttatcaaaagtcgtgaccgtttgctctgcgcctaacactctagtcgcagtcacttggccttgatcatcaaccttaaaagtgacagtctcattcttagataattcaaacgtatacttcgaattataatcaaagactaagctgttatcttgggtaccgttcgtatcactagccgcaatcgcaacttgagccgcatcctgattatatttgaccgtaaaaccactatcgttggcataaatctgcgagacagaacggacattatgcttcgtatcttgtcgtactaaaacactactttgattaccaacgtcaacccactgcccagtcgttggttggtaataataattgaccgttgttggcttttccgttaccgttccctgggcattcgtcggtaagcgatcagtatcaactgtgtacaaatcttcgaaatcagttgcctcggtcgtgtaagtatcaccatatagaccagtgacatccaattcgtccagcttctgcccatccgttaacaagtaattgacatgaatgttgtatggcaacggatcataatacatcacggcttctttggtagtcttgctagcagtgccacgggtatgttcatccaatgtggcattacgcttatatccagttatcgttttgaccgcttagtaacatcataagctttcccgtaaccaactttgactgtttcatcaggagcaaccttatcagtagaatcggtcatgtaatgatgtaccgtgatggtcgcttgattgtcaatggtattggtgacggtattcgacgtcttaatctgcttatctattgccgtttgaccagttgccgttactttggcctggtcatcaacatcatcactgaactggacttgagccttaaagtgataggtctcacctttaaacggtagcgatttaatgcccgcgtccgtcagatgccatttcacttgatgtgttttttcatcatagctgacttggtaggcagtactaggtaatgcttggccagcatcattaacgacttcgcccttttagcgtacttagcgttagccggaatcgtaatattttctgaccaatctttatacttggtcattaaatcctgatccaaaacattgactttttgttgtaagtcatacgttaacgtccgattttgcttgtcagtggcactttgtgtggcactcaaagtgggcgtcgcaatggcgggcgtccccagcgtgatcgtactaacgttgtagactggttgtaaccatgaattaccactattaacacgggtcgtccgtagataaattccagcttcgtcccactgaccccaaaagttgcagccgttgacgaggtatatggccagctcgcatcacgcgctgtttgcccagccatgacgagttgtcctccaccgaggggattcgcaatttgcttaacaatcgagttttcaacagtataaatcttaccagcccctaagtaagccgtatattcaaagccggttgacgtccccgctaccggaccatccagactagatagcgtaatgaacgcgtgcttttgaatattgaccgcggcatgcgtatcagcgtaataaaattcatagctcacattgaattgggccacatttgacatggtcgtgtccgaagaaaagcccggaccaatttgaaacgccccgtcagtctgtttcattcccgacggtgccttgtggctgtcgtcgtgaactttaatatgtgagattgttactttagcagtgacttcctgaccatggaaagttcccactgtcccataggttgaagtaatcgtatcactgtctttcaccttatgtatgagcacacgttgcgcaccgttcttaggtgttagactgccacgatctccagcattattcgtgattccttgtaaggccgtgtcattttgcttgatgactagctgattgaccagtgggagcgtgcccccgttgcctggtaagaccgtgaccgatgatgaagcatcaaccaccatgatattttgtgacacaccccagaaagagatgacgaccagtaatggcaacaaccaaactggcgaggccattacgatgatgtttccccgtgttttccgtatacatgtttaaccccttttatctaactatcacttatatagtaaagcgacccaactaactactcatagcaggttaacatgtattttgttaaaaaacaataaatatttttatattaatatcaatatacattgacattttcaattgtataaattctttacgtatcatgctgatttttctaccctaaaccatggttaaagcttgccatactaagcacaagagcaatcagcttagatcagttggaaaagtacaattttgtataaacttgcttatttagctatggctttcttccggtttagaataaggtccgcatttactgataatcagtaattcaactaaattggtacgttttaatcataattaatgcaaaatagcacctagtctatcaaatattaagcctttttctgctaatcgaagactacccaactgaaaggtattttatatgttgccaaaccataaaattttttaattagcagatgtcttttgctcagttaatgaaagcattcatttcacccattactcacaaataaaaccgtgaggactgttgtcaattccaacagtcctcacggtttatatcaaatcagtcataaaattatggcaatacattaaacaacagtgcgcctaacgcaccaccaaccaatggtccagcgattggcacccaactgtaggcccaatcagaagttcctttattggcgatgggcaataccgcgtgcgcaatgcggggccctaaatcccgggccgggttaattgcatacccggtcgttccacccagagacagcccgatagcgataatcagaattccgacaacaatcgggttcaatcccgccgtaaattggcctttcgtgaaggctaacaagccaaaaactaggacgaacgttccaatcacttcactgataaagttccagaaataccgccggataccaggaccggttgcaaaaatgccgagaatcgcgccagcatccttagttgcttgccagtgtgggtagtagtgcaaccaaaccacgaggccaccaatcaccccaccagcaatctgagccgcactatatggaatcacgtaggcccatgggaacttaccggccactgccattcctagtgagaccgccggattaagatgtgcggggctcataaagctggacgcatagacgcccatcgtgactgcaaatccccaacctaaggtaatcgcgacccagcccgcattttgcgctttggatttattgagtgttaccccagctacaaccccatcacctaacagaatcaagataaaggtcccgagaaattccccaacaattgtagtactaatggatctttcatcatgaccaccccattccttagccccgcttcagtgctgttaagtccgattcagcaatcgtctgattcaataattcggtttgtgctttgacagttgcagcatcccaaccaaggtaattggccattgtcgctatgacgccatcctttaagccatccagcgtatctcgcatgaataacaagtggttagtgcgccgcagcaagtagtcgactggcgtcagggtcatttcttcatccaaagcataacgtaagctaatcgtttcggctaagctcagaccatgcgtcggttcaactttaccaatcaaactaaagacccgcgcagcattggaaccgtacatatttgcaatccgcaacgcttcatcattcgtcaaaccattatccgtcccttgtttagcataaaatgcaatcgttgcatccacgttgtgcggatcaatatcgccaccagaaacggggaggttcttcgaattgatttcattaaagtgggcatcatacttatctgctaaaatcttggcaatcagcgccatggcacccgcagccattttacggtaatcagtaattttcccaccagcaagggtcaacagcccgtctggactactagtcaacgaactaccgcgtgaaaccgctgacggactgagtttgtcctctgccaaggaagaagtttcccaagtcattcaggacactttcgacatcttcacgactggcttcctgactttcaaactgatcaacaaccttgataacttccttgaagctcttatcgctgatttttcctgaattaccaccgttataatcggaactaccgttagcggcgatcagtggccgcaatccggcccaactagcctcaatatcatctaaggtgattttagcagttgggaaacgacggttgacgatttccaacaagtaatcaacatcttcttgcgtaacggtcggatgtttcagatcaccatggtaatccgtatcagtcgttccgaaatacgtcttgttttcacgtggcaccacgaagatcatccggccatcttgatcaccagaatcaaaataggttggttgtggcactgggagtttctcagcgtcaacgactaaatgtacacccttggttggccgcatctgggattgatacttttcagtatggtccatcttacgaatcgtgtctgaccatggaccggtatcgtattgataacgattcgggcatggatctcgaacgatgcaccagtcaataagtcttcagcggtgataccattgatccggccatcatcatcatgtaagaggccggtcgccttcacatgacttgccataatcccaccattttcgtgagccttcttaatgttttcaatcactaggcgcgcatcattattccgaaaatcaaggtaaacaccgccaccaactaaatgtttagggttcagctgtggttcccgttgtaagacttcctcgcgcgaaagggtataattggtgaatttaggatctttaacttcggcgagcttatcatacagatccatcgccactttgacagaaaagaggtcgaaggtcgctcccgtctcatcataaatcggcaataacattgggtcgggcttaggaatttgtggcgcaatccctggacgaccgcccgttctttaacggtatcggcgactacccccacgtcaaacgtctttaagtaacgaatacccccatggaccagtttcgtcgaccgtgatgaagttccttctgcaaagtcttgcatatcgatcaacccggtcttcatgttcattgcggttgattgaatggcgacaccggcaccggtaatcccaccaccgataacgagtaaatctaacgtttcattttgtaagcgttcaatattttgttgacgcgtcgttgctgaaaatgccatgttgttgtcctcctctattttcctgcgtggtatggggtgtgcttaaagacttgggtcgctttgaccgctgcccgccatccctcgtataagttcgtccgttcagctggccccatctcagggtcaaaactcgtgccgggcttatacgacgcttttaattcttccaaatcccgccaataaccaacgctaagcccggctaagaaggcagcaccaagcgctgtcgtttccagattagcagcccgcataatttgcgtatccaagatatccgcctgaaattgcatcaaccagtcattacgagcagcgccaccgtcaacttttaatactggaatctcaataccggaatctttcttcattgtttcaaccacgtcccgcgtttggtaagccaatgcttgcaaggttgctttaataaaatcttcacgagtcgtgccacgcgtcaagccaaagactgagccacgtgcttcagagtcccaatatggtgcccctaaaccagtaaaggccggaaccacatagacttcattttcattatgcgattcgcgcgccgcccgttcagaatcgggagcgctttcaaccaggcgaatcccatcacgcaaccactgaatcgctgaaccggcaacgaaaattgacccttccaaggcgtagtacactttaccgttgatgccgtaaccgatcgtggtcaataggttattatcggataattggggtttttcaccggtgttcatcacgataaaagccccagtcccgtaagtattcttcacggttcccggttcaaacgccagttgaccaaacaaggccgcttgttgatcgaccagccatcccactaattggaacttccgacccaaagaaatgatagtccttggtcttgccataaacttcagaattagtgcgaacttctggcaacatcgccgctggaatatttaataattgcaaaatctggtcgtcccacttcaaatcatgaatattgaagagcatcgtccgactggcattggaataatccgtcacgtgggtggccccaccggtaagtttccataggagccacgtatcgatcgttccaaagagtaattcccccttttcagctcgttcttgggcccccttcacgtggtctaagatccaacgaattttagttgccgagaagtaagcgtctgtgacgagtcccgtatgttgatgaatcaaatcaccatagccatctttaaccagcttctcagcaatcggcgcggtttgccgtgattgccacacgattgcgttatagattggcaagccagtttgcttgtcccaaacgatggttgtttcccgttgattcgtaatcccccaataccactaatttgagcgggtttgattcccgattcaatgaaggcattcgcaatagtagacaagacagcattccagatttcattggcattatgttcgacccagcccggctgcgggaaatattgtggaaattcccgttgtgagtcggccactttatggcccgcatggtcaaagataatggcgcgggtactggttgtcccttcgtcaattgccataatgtacttgtcggtcatggtgtgtcactccttagtcataacagttttatgaaagcgctatcataattgatgattgaatcataccatgtcgcgaccgttttgtgaatagatttgcataaattaaattttgcacaattgaatttactttaaaactagtttgtactatgtcacagttcgatactgccatagcaagcatcgtagcatttaagcaatcgcttctagttctataaaataattaatttactaacattagtgccaccgcgacgagctacaattttgacatttgtttcacagtacttacacgccaagatagtcgcacaacgaaaatgacgaccgtctgtttgcgacatcatttggcctccgtattccactccaaacgccggtcaaacaaaaaagagtggccggtcattcctggtcactccgttagtgctgacatattcagttaagctgaatagctggactttgatttaattcaaccacacattaatacaaatattgtaagtcactagccggcgttgggtaagccaataccaaccgttgtaaatctggtaaagtcacgtgtttttcaattaacaacgtgaagtagttaatcatctcgtcggcaacatcacttagaagggtagcacccacaacccgcccactcgctttagcaaccactactttagcttgggcttgttgtgcgccaaagcggtaataagtgaaccacttcgtcatatcaagtgtattgacacgatactcatctggatgctcagtcgccacggccgcgctgatcccgacttgcgctaatccttgggcgctgcaaaaacctgcgttggcacaacgggatactttatggctgcgccaggatgcgtcaactcaccgaccagataacgcgcttcaaaacccgcaactggcgttaacttcggtaccggtgtatcgctgacatccccaatggcataaatgtgcgggttggccgtctgcaaatgatcgttgacttgaatcccatgccgatcaaaggtaacgcccacgttggctagacctaactggtccgcgttcggaatccgtcccgctgagctgatgaccagatccgttgtcagctcgaaattatcagctgtcaattgtagaccggtcgccgttttagtaattgcttggacatccgtattcaagtcaaacgtgattccatcagccgtcattgcggccatcaaatccttaaccaaatctgcatcaaaagcttttaacgggcggtcattatgatgaatcacgtgcacatcagcgccagcggcattcgcaatcgtcgccaattcaaactctcctacgtagccaccacctacgaatgtcacgcgtttaggcatctggtccaaatctaagaagtcagtgctcgtcttaaagtattcgtgcccggtaatcggtagaatcgctggacgctgaccagtagcaatcacgtaatcagtcgcactgactactcgatccccgaccgctaactgattgtcggattgaaagtgcgcttgaccatgtaacgtcgcaatatcttgcccttttagtccgttcaacgtcccatcgttgatgccatccgtatagcctcgtttatgcgccatcagtgctggccaatcaattttgggcgcgccaaccaggccccgcccttgtaaatgttgcgccgcttgttgcgcttcgacggcgcttaacaggattttcttagggtcacaaccgcggttaggacaagtgccgccccacagatccgcttcaacgatcaacactgtcttgccctgagcctttaatccgctagccatggcattgccggctggtccgccaggcaccaatcacaacaacatcgtactgttccgccattcgaaattcctccttaaattcattagcgaccatcaattatcacaacctagtgtaactgatttatccttaattgacgattaagatacttcttcatgttgactcaagtaagccacgattcgttggcgatccaaatagccaacaacccgattttcttccgtgaccgccacataatcgtgatctgtcaatgccgtaaaggcggtgcgtaacgtggcttgaacgtctaacgattgaatccgaccactcgcaacactgggtttttctgtgagataaccctgaataagccctacacgcccaacgtagacatcatagacatttttagctcggctcgcaccaaagaagttccgcacaaagtcgttcactggatgctgagccagagcagccggcgtatcgacttgtattaactgaccgtgttgcatgacaccgatccggtcacccaacttcaacgcctcattcatatcatgcgtccacgaagacgatcgtgttgtgatagcgggcgtgtagccgtaagaccaagtcttgcaattgttgccgcgagatggggtctaacgcactaaatggttcatccatcaaaacaatatctggttgcgccgcaatcgcccgtaagataccgatgcgttgctgctcaccaccggataattctgacggcatccggtcacggtattcctttggatcgaggccaacttccgccaatagctcatcaatcgtttgattaatttccttcttagctgtccctttcatttctggaatcacggcgatattttgcgccaccgtcatcgttgggaacaaggcaatttgctgtaagacataccccatttgccaccgtagacttcggactggtatcgtggttgtatcagtaccattaactaggattttaccagccgtcaatggctctaagcagttgatcattttaagtgacgtcgttttgccactcccagaagtccctaccaaaacaaatagctcaccctgggtcaatcgttaaattaaggtcgggaatcacggtctgcccattaaagtctttctggacgtgttgaaattcaattgccgttgtcatttaacgtccctccttcaataaaccgtgcttcacaagatagcgatgtgcaaccgtcgaagcggactgcttcttaacattgacttcatagttcatttcttgcatatcagtttctgaaatctttcccgctaacttattcaacgctttaacgaccttaggatgtttgttggcaaaactcgtcttcatcaacggtgccccttgatacgttgggaaaaagtgcttattatccttcaataaggccaagtgatactgccgtaattcactatccgtcgcataggcatctaccaagttgattttccccttactgatggcttcatagcgtagcgccggctccatcgacttggcagtcacgtctaacccataagtcttcttgattccttttaagccatcattacgatcaataaactctagggtcattccgggtttcagaatcgattcaacttgtgttaagtcactgattgtcttcaaatgatgttcttgttgaaatttcttagtcactgccaatgcgtacgtattgttatactgcatcggcttcaagtaagtcatttgttcacgcttagcgaggcgctgtttggcgagctgataggtctggttagctgtttgaccagctgggttatttcccttaactaaggtctccagcaccgagccagtaaattcaggataaatatcaacctgattattctttaacgcgctgaataagaacgtggtcttgccaaagttaggcttgagcgtcacatgaacatgctcatcttcagcttcaatcagctgcttatacatattaatcaagatttctggttcagaaccgagtttacccgcaatcgtaattgtttcaactcgattggcataaacactataagccccgccaccacctagtaaagctaaaataccgacaaagacgattaaggcgtggcgtggttttagccgtttgaaaccaccgaacgagcgcactcagcagaattgctaacaatgctgatgagatagccccaatcaataataacgaggtatcattacggtcaataccgagcatgataaaggtcccgagaccccagcaccaatcaaagcggccaaagtagccgtcccaataattaagacgagcgcggtccgaatcccagcaatgatctgtggtagggcaatgggtagttcaactttaaacaacttacgcattcgtgacatcccaaaggcatcggcggcctcttcaattgaggcgtcaatttctgagatacccaaataagtattttgaaaaattggcagtaaagcatagatcaccagcgcaattactgctggcaccgttccaatcccaactaacggaatcaataaccctaacagtgccaaagacggaatcgtctgtaagacactcgtgagttgtaacaatccctcggcccaccgtggtcgtcgaacgacccaaatagccaacggaaacgatcgcaattaccattgcgatgactaatgatgctaatgaaatccccaagtgttgccatagcgcagtcagcaaatccccgcgtcgatccataaacgtctgtattaatgtctgcatgctaacctccagtgctcacctttattacttaataacttcttaattatccatgtatttaatcgtagcataatccgccaaaaatcatagtaatacgcactgacaattcactaaattttgtaactattgtagtttcatgttaaaattattcattaatttaaaatgaaactggctagtttttacgaaactattagatgaaccactcaatggattatcattacaactaaggaggccccaacaatggctacgattcatctttaccttgcaagtaccaaccaccaatcgaccaacatcaccgcaacgacccccgctgcctgggtcgtcattctgcgatatgctgaccatcaaaaggcactaaacgacggtggctacggacataccgaaacttcactggccttgagtgctctgaccaccgcactcgccacgttgaaacgtcatgatttacccgttcatattcacaccacaactgaacaagtggcggcggttattagcgaacaacgttatttaagctggcagcaaaacaactgggacgttcccgaagccgaccaaccagacctaccccaatggcaaacgctgattcccattatcgaagaatttcccaacctcaccatcacctaccaccccgtggacgatcccgcgatgaccaccgcaacgactacgctaacggcggtgatgacgaagctataaaatcgaactcatttcctgtcagtcattttggacataaataagccgatcgtatacttgacggtcggcttatttagttgaattaatttcttcataactactgttacaatctcgcaacaaattctacatatagcttatttccaattgaattcatccacaatgattgaccaacaactacaggtcccgcacatcttcagtattagatgtgaaataatattcattgataactcgatacttccctctagttctttcagcgatttcttcataaatcgcattaaagtcacgttcgaatgcattctcatcttcatgcgttttaaatccattatatctaaattcataaccattattggtaaacagctcgctatactgacgatttaaaacgtttaccttcgccactagtcctgaatcaggatatagctcatccgggagtccatttttaatcaattcattatcctcgttatatacccaaataaaggaagaaccccattccataaatagtcttattttacgttttggcatagtagtgtctattgactcagttgctgcggccatcgatacaacgcctgttttccttaaatacatcttaacttgtaatttattggcgggtaaaccagttatcgtaatattggttaacttattatttacaaagacagcaccacaatcagggcatgttttcaataatcgcttatgggcattagtcgtacaattcaattgaagtcgagccagattacatttaaaacatagttcgtccaatgtataccgactcataatatctatcaattgcattacttgccgacacattgccgcattaccaatatttttcgccaccatatctttattattagcaacaatctcagataaattcttgtccgtatgaccaagaatataatctttcgcagtagattgttgaactgttttcaacgtaacttgaccggtatattttgtaaatcttctacgataaagcttagttatatcgactaaagcgtcatacgtagggcctaaattttctatatcaaaattctgataaaccttcaacagatcagcttttaatcctggatacgtccgcacatgagtctttgcttttgtatccactacaggtttaggtttattaacgatagcactatttaattcagcctcactcggtatagcttgcgacgatgctaccgtcgttgctgttggaaataccttgtctactttccccgtaatttttgtttaagaccgcgtacttccccctagtcgccgcttcaaatccttgtgaataaccatgaatgcacgtaaaaactgctgttcatctgccgcagttgcaaaaccattgtagctaaaatcatgctgattattagtaaacaaactatcgtattgcttttgcaacaccaatagtttttattaagcgttgcgtcctttcgcaatacttgcggcagatcattactaattaggttacccttctcatcatacaaccaaatcggataacaaccatattccaacataattcgaattttcttcacccgtggatatttatccaacaacggcgccggataagcactaataatgtactggtctcgcgacaacgtcactgctaaaaggtgctttcgataccgatagtgaatagtcaatagtacacgatgatatggttgccacttgtcaaagtgcccccagatcgataatagctattaacagctttcgcaaccagtttaggaatagcagtttgtgagaaactccttgggctgcaaatgcttcaccatgattttgaataatatgttgaaaacccatgtgttggttgccactatcaatccagtcaaattgagtatcatcttctcgagcagtccgtttttcgtgccagaacattaaatagttcatcgttgcagccaaaataacgacgccaataacaccaatttttttccggcaaatcaggcatcattatggttaaccctaacgttgccattacacaaccgagggacagtatgattgtcaacaaattagtaacgcctgcgtgtttgacgaggtaacagcagtaactgattccaacagttaagatgcttaccaaacctcctacaatcaccactatctatcccctttcaatatcatcaaaccttatagatcaacaaaccgcactttactgctaccatgaaaacacggcactttttacttctatttataatttacacccgttaattttttcagtgtccatgttagctctataaaacgtcaacctcatcatataacacagcttcattatttacaaataaagtaatttcactatcctctttcaacgatacatggctactaattaaacggtaatagcagtcatacttagcatagcatcaagagtcacatcgaattaataattcgaataaactaaaacaacataaaatggctacttcaaaaattataaattagtttttgaagtaaccatttaataactcgtcaaaaatacgggcgtactcactttattcaactttccataaggttttaatacctataacgagtcaataccaacattattctatcctatttttccatgccgataatgccgactcccggttcgccggtccttacgccgcgtaacttttgacagcttagccgcaccattgacggctgagttcatcatgcggtcaaactgacgatcactcaaccactgacgagccgttaatgagacccccgcgcccataccgcgtgataacgagtcttgggcttcacatcattgacagcgtgaaccatcagtttagcaatcactcccggattggaagcaaactgatcgaacaatgacagcatcgcaccgaccttaacggcttgttcatgataagccgtttcaccggaaactgccaacagctttttttccgcaattccagcccattcagtcttgattccaccaggttcaacgatgacaacatctataccaaatggtgcgacttccatccgtaacgaatcgctcatcccttcaattgcgtgtttggtccccatataccaagcacttaaaggctgatagatctttcccccaattgaagaaacattaatgatccgaccacgatgttgtgcccgcatcaacggtaaaactaattgtgtcaaccgcatcacaccaaagacattgaccttgaattggtactcgccttctgcgaccggaacgtcttccaaggaaccgtatgagccataccccgcattgttgattaggacatcaatgcgcccctgttcgacctgaatcgtcttgacaaagccgcgattaacgtcgcttcatccgtcacgtcgacttttaaaacgtgcactccagccgctgctaaatccgtcattttttcaatccgccgtgcggctccgtacacaatgttcccctgagcttgtaacttcaaagcagttgctttaccgatccccgaagatgcgcccgtaattaagatgacccgtggttgactcataatccgttcctccatcgttaactgtatttactgtcatgctacgtcaaacccttcacaattgcaatcgaattcattgcccgtagtatgctaaaatagaactaatttcaagcacgtcaatttaattggaggaatgaacatgtcaacaaagattatcatggacactgaccctggtattgatgatgccgccgcaattacctttgcgttaaatcatcctgacttggacttacaattaattacaacggtcgccggcaatgtgacggtcgacaaaacgacgctgaatgcgctcaaactaacgcgcttctttgctaacagtgacgttcccgtagcgggtggggctgcccaaccgctgatcaaaccgtttgaagatgccgtccgaattcacggtgtttcaggaatgccgggttacgacttcccgactgaccttgcggaaccattaccagaaacagccgttgaagcgctccgtgactacatcatggctgctgaacaaccgattacgttagtgccaacgggagcctataccaacattgcgctcttatttaagacctaccccgaagtaatgccacacattaaagaaatcgttgcgatgggtggggccttaggcaaaggtaatatgaccagcgccgcagagttcaacgtctttaccgacccgcacgcggctgaaatcatgtaccaatccggcgttccaattaccatggtcggcttagacgtgacgatgaaggcccttttaacgcgcaaatcgattgaacagttaccgaccctcggtaaaactggcgaaatgctccacgccctctttggtcattacaacgaccgcaaccagactggcgttgcgatgcatgatgttaatacgctcttctacttactacatccagaagccttcacgactgaaaagatgtggattgatgtccagacggagggccccgctaatggcgagaccgttggcgatattcgtggtgcttaccatgacggcaaaaccaacgcgaccgtttgtgtcgatattgatgcggcggctttcaataaatggttcctagaaaccgtggcagccattgaccaatctaaataaaccactaccaatcgtcattaattaagctaaaaaatgaaccacttcagcttgcacaactatcatgtgcgcttgaagtggttcatttttaatttgtgtcacgcttttatcaagacatagtgctactcaaagtgcttaatacgctcagcaaccactgattgtacctgattaaatgtcatccggtgtatctgggattaattgaatcaatggttgaccgaagttgacttcttcaccattcttcactaggaaaagggccttgaccgtccccgcttgcttagcaaccacgggccgcatcatctgcatcgcttgaatgagaccgacttgttgaccaacgctaacgtggtcgcctaacttaacgtatggcgcttcttctgaagaatgcgctgggtaatagattccgacgaccggtgccgtcacgcattccttaggatcgattggcgccggttctggttcaggatcaggtgttacaacgctcgtcggattgctagccgtactggtcgccactggggttggttccgcctccgcaacaactggggtactaaccgttgagaccggtgtcggtgtgaccggcgttgggtcaatcaccggctgattgggaagtggcgccggctgcggagtcaccgtcgtcttgccgtgtcccttcttacccatttgaatttcaaaatcttggtcccgatactcaaaactagttaaactgctttgttcaaacttgtccattaactgataaatcttatctaattccatacaacacccctccctccaattaatttacgctttgattataccgcatagtttagcgcaggagtgtggtggaagtatgaacgcttctttaagaattcgtcaatatttcgattaagcagacgccaactcatgatccgccggaactaatttaaacaaaaataatggtgctggtgacttacccgctttgcgcgtacgctaacactgtatcaacgtggtctagctgtaacaaccgatcatcaagttgccacaagccgcgttggtaatagtcgcggcaatattgcacgaggttggtcaaaaagttaccgacggcctcattgaccgtcgcgccacgcccatcgacaccccaaaaatcggcggattctaaccagtaccgttgttccgataattctcgataacgaccaacttcatgaattaacactaaccgtgctgtcattgccaaggcccctttcaatctcaatgccactttcataatgacatctaagatagcaccgataattagccctgacaatcctgaagatggcaaacccgtttcaaattaaggttattaacgaaaatcgccttatttttcaatcaagtgacgctttttacttaagattctgaatcttgttcgtgtcgtaaaaacgtgccgtggtggttcaggtcggcttgtaaatcagccattgtaaactgatgatagtaagcccgatattgacggtcagctactgtaaataaatccgtcaacgtttcactaatattggccgcaatcggggattgatcagcctgttcatccgttttggatggtccgtaatgaagcgcgcatagctaattgttgggggatggtcaaatcatatagatcgccgaggttcatatcggccaacgccaagtctaattggtagcccccatttttaccaaccgtccccgttaaatacccatgcttatgtagaactgataaaatattgcgaatcatcaccgggttaagatgcagtgactgcgcgagttcccgactagcgaccttactatcacggtgtgcatcatcaagaggtacaggatactatgcaccgccaccgaaaaatcaagtttcatgttacttcctcccacactttgtcataattctattctaccaccaactgtaatgactctcatttcaattagccccaatatgcgggtataatgtgtttgggagtgaaaaaatatgtcatctacaatcagtgccgcaacgttcaagctaaatgatcaagctgcgttgtcaccggcacaacaatcattagagcaccaactattaacttttatccgtacccatcgccagcaaaaacagcccagcctctttgttattcatggtgatgcgggaactggcaagagtgccgtattagccgccgcgtttgctcggctacaagccctcaatcgtagcttgacaccaaacgatttgcgtgccactgacaactatctcgtcgtcaatcacaatgaaatgctcaaaatttataagcgcttagctggtgaagatcccgtcttgcgcaaaaagacttccaaaagcccactccgttgatcaaccggttggcaaaagaacaccggcaagcagacgttgtttttatcgacgaagcgcacctattactcacgcaaccagaccgctataaccgctttacaggtcacaaccagttaacggaactgatcaatcatagtcgcgtcgttgtcctcgtcttcgacacccgtcaagtcttgaagttaaagagctactggcacagcaacgatctcaagccatttttagaccagtacccgcacgcgagctacaacttagacgagcaatttcgggtcactggcggcgccgatgttgtcgactggatcgatggttttacccgcgggcaattacaaccaaaacccgttagcgataactttgatctacgctttttgatgacgggcaacccttatacgacctgatcaaacaacgcgaccagcagtatggactcgctcggatgatggcaaccgctgacttcccgtacgtcgttaatcatggcacttggtacgtgacggccggacaattgactgaagcttccgtgggataaagtcaacttaactgatgatccttgggccttacgacctgagacactgaatgaagttggttctatttataccattcaagggtttgatttgaattatgcgggggtcattctcggcccttctgtgggctatgatgaagaccatgatcggattgtcgttcgccctgaacgctatgaagatcaagaagcgttcaaaaaccggacagacttaggcgatctgcgtccccttaaacagcagattatctttaactcaatcaacgtcttgatgaaacgtggtcgttatgggctttatatttatgcggttgacccagcactacgccagcgactattagcgttataataagactaattacacgaggagggatttgcaatgcaactatcaattccgaccatcaatggcgcccttgcagccacctattccaaacaagcggccgttgcccaaacgtataagggccaccccatcatctcgtttcccgttgacattagtgatgtgccagcagcacccattcactggcgttcactttcgttgaccacgatgcaattccggtaggtggcttcacctggattcattggattgccgccaatttaccggcaaccacgacccacatccctgaaaatgccagtcagaccggtgctattccgatggtccaaggtaataattccacagcgggcgcctatgttcacgagactgatccgaaagttagccaacactacgtcggcccgtatccgcctgacaaggatcatcgttattcatttaaactatttgcacttgatactgagttagacctccaacctggatactggctcaacgaatttcatgatgccattgccggtcacgtgctagcaactgctaaaacgacggtcattggcaaagtgtaatccaatctgccatataatatggatagcttagacaaccaaaaacgttgctacagaatcacgtagcaacgtttttattaacactaatataatggcattacttcaaagaaccggtcctaagcaaaatacatcagaataaacgcaattaatgccggtagcccctgaatcacgacgatcgcgcgactgacagtaatactaccataaaccgcggcaaccatcacacaggctaagaaaaacagggttgccccgacgctcgcgacggccggaatcacaaacaagctgtataaaataccgacggccaagaaaccgttatataacccttgatttttaaacaataattgcactgacggcgactgtagcgtttgccgtggaattccaaacgcttttgcggccatttcactatccgcattaaacatttccagccacaaaataaataaatgttcaacggcaaccaagatcgccataatcattgctgcaacgtgcatcctaatcccctcctttttcggtccttacttgaattgtaccagttactgcgcctaaactgtagaaatacagacttacttgtctttatacgagctaattcgtcacaaatcatgattaaaacatggtaaatcccggggtcaaaaccgccaccgttttgaccccgaggtgcttttaaatgataaagcccggctacgaccaagcagataacttgctagttgcaaccgggctttattcacatctcatcactaaattagcttaatctacacttacataccgggcatccaaacatcttcgggcttgatgccttgttccttcgcaaaagcattccgtaaggtgtccatatccattaaatgataagtttgtgggtgttggggatcatatgattcaatttgggccatcataccaccatcttcatgttcgatgatatggcagtgatacatgtaaactcctgtcagctcaaatttgaccttgatccgcaccgtttcaccagggttgacaccgaccgtatccttcagcccatgttcattaggataaactggaccatcattccgtgccaaaactctaaactgagtcccatgaacgtggaatggatgaaccatgccgttttcagtactgttggtgttgcggatttcccaaatggcgacatccccaactttttgccgagcgtcgatgcgactcatatcgaatttcttaccatcaagcgcgacttcatcatccatcccatccatcgtgattgtgcgaacaggtaagtcaggtgttggggtttcatcaggaatatcaactaaatgttctggtagtttggtgtcatccggtacgaacgacttgattcggaagcgacatagcggcgtatcatccgtcatcagcgtgacttcatcgcccggctgatactgaccgaaatcaacgacaatttcgtcccgttccgcacaggtcatcatcactttagtcatataaaccggtgccggcaaaatgccaccatcggaagcgacctgtgcaaattccaaatcgtcattgaagtgcagacgccattcgcgccggttcgacccatccaagattcgtagccgcacccgctgcgtcgtcacatcaaaatatgggttgaccgtcccgttaactaacgccgtatgtcccttgaacaccatctggatcgtaatccgcccggtaatcaaattggttatcatcgtgaaattcacggtcttgtaataccaacggaatatcatccacaccataattacgtggtaacggtaactgatcttcaacgtcatccttaataatcaccatcgttgctaggcctttccagacgcgtcgcagtcgatgggcacggatgagcatgtaaccacgtagtcgcagctggttgatgtactttaaagtcaatgtgattcgtttcaccgggatagaccggtgcgtggcagccaccatcggtaatgggccctgggacattcaagccgtgccaatggaaagtcgtcaattctgggagtttattttccaagtcaatatgggtctgcttaccattacgaaagacgatagtttggcctaggaagcccgcattatagccccacgttttagtcttcttaccaggtaaaaactgagtttcgctttcttgtgccgtgacggtatagtaatcatcatcccgtatccgtctggcgatccggcttcaataacggcggaatcgctaacggttgtgactcgactttcggtgtaactagtggaatatagccaccgtcatgtgtgttgtaagcgggttcatcaaaaaaataatcagtatagacttttttgccatgttgacatccccttagatatttaaaataacttagattcaaaaaatggtggcgcttttatacgtcaccttcagtttagaattattttaaaaagtgtcaaacgaatttcagtgctcaattgctaatcattaaggtcatgctgtcgtccctgataacacttaaaatagcgcgttgactgtattcgtggttgcatcgcccaaccaagcattcgtcaccaaatgatcaaaatagctcgtttcaacaacgccagccaaagttgccaattcaacattcaggtccgtaagtttggcatacgttggaaaatgacaatcgatcaataaattgccgctatcggttaacgtgaagccatccccgattattagcagttcgaatggttgcctgaccgccaagatcactcaccgtccgcatgactaacgataaggccgctggtagtacttctaagactagtggcgtcttgatatcaaattgatcgactaaccggtctgcatcgttaacagccaatattcatccgccaaactggcaataatcttctcattagcatggattccaccgccacttttgagcgcgttaccgtaatgatctaactgatcgcagccgtcaaaagcaatatcaacccggtcacaatatgcagtatctacaacggtatacccgagaacggtcgcaagctggcgggtcgtcggtgatggggtgacgaccgtaatatcattcacatgattggctgcctccttgaccagttcactaaccgtcgagccaccaccaaaaccaacaaccatttgcggttttattaacgtcaaagcttgttgaacaattgcctgtttaatcgtcatatcaatttccttccatcatcatcaagatattctcatcatagcacgcgataacctatttaactaactttaatcgcaaccaaatcacacgatttttggtcaaattcgggtctaggatgaggcccctatctcagcaacgttttaaaatacaattattgatggcgaccttcgtttttggggaaagagggttacaacaatgaagaataagtacagtgctaagttaggtttaaccacaataaccgtgatttttggtcttgggctgacaccaattgccaacgcaaaatcgattgcgacaccatattcacggagtcgttggccacacgctcaagtgacctacgtcattcaagcatcatcatacgagcggcacgtctatcaagtggccatccaagcctggaatgcgactggttactttaaattcgtgccgggaaccactgctcatcatcaaattactttggggaccagtaatgccaccagtgggcagtattatcgcttagccggtattactttttcgaccggttataccaccatggttattacacaaaagcgcaagtgtacttgttaacacgtaattttgtacgctaccactattcttatacggatcaagtccacgtggctgaacacgagttaggacatactattggtttggaacacagccgtgatcgccacagtgtcatgttagctgataatcgctataacggtattagtgcagccgatagcgcggcggtgcatctgcgttaccgcttacctgttggcgggctttaggtaaagctatccaactaggtctgccattaataccttgggtgcggtgaccccactttgatgtttacaatcaataccgcacccaggaaggccgcgatgatgagtcgcgaccttttttatgagcaccgatggccgtaatcattgttgaaacataacttaattagcacgctaaaaatgattgcagacaaaaagcactttgatacgaggaatcgaccgtatcaaagtgctgcgcttagctgtgcagtaaataaccatagcttcctaaaaataactagtacataccctgtagccgtgactaatgctagcaacatgccgcttccaggttgccacccgcggcgatgacaaaaagtcaaacagccactggttaacaacattagcgcaaacgttgctgcgatgactccgaagaactggccccattgaccaagcaaggcacagcctactcccagaatcgtcgcgattacaatcacgaaccaccgttgccggtttgttaattgtcggcgcatattcatcccaccatatagttaatgcagtcaacgttctgcttagtaaaattttaacattttggtagaagtttgccaaacaagacaattaacaaccgtcactttttaggcttgttgacgtttttactgattgattgcttaagacgtcatcaaaggcgtggaatttctcgataatcgtgtccgctgaattacggaacttagcttgttcattagcagtcagagcaagcgtcgtcacactctcgaccccatctttgccaatgattgctgggcctgaccaacatacgtcccaaaggtctcactatacgcagagaccgggcatgctaagcgagcatttgcaaagaccgcttcacttaatttaactgcgcaagtagcaatggcaaaactggtataccccttaccagaatgaaccgcccagccaccatggcgtgcagctgcctcaagtgcatctaagtccaaatcatacttatcaactaaggatgtaattggaataccgttaacctgaaccgttgaccacgcgctgaattgtgattcgccgtgttcaccgtaaacatacccgctaatgtttttggatcacagtcgaaggcttctgcgacaaccttttgcatgcgcgccgtatccaagaaagtcccagtcccaaagacctgttggcgtgataatcccgttgcgcgttggaaatagtgagtaattgcgtcgcacggattcattgtatcgatgaccacgccattaaatttggttgctttaactttcggagcgatatcttgaacgatttctgcttcgtatattcaaattcagcccatcggttaccggaagcatggtctaacgcgtgaatgttgccactagtaacaaataaaatatccgtgtcgtctaattcatgatagtcattgattttaataatcgttcgactatctaaacgggcttgagcgtcttgtaaatctaattgctctgcgcgagctttagccgcattagtatcaatcaagactaattcatccgcaattcctttacaaactaatgtataagcaatggtcgcctcaacgtggccgaccccaataatcgcatattttcgcataagctgaacccccgttttaattattaagacgttatgtaataatctcatcgtcttttaatttatgtggtgataaccttactgctctagttagtaatggtcaattgctgaaagcgcctcacctttcatatcatcattttattaagcaatagcacgcactatagttaccaattcccctaattagtttaagataattaatcacttgcccccccattgcctaattattttcattaccgaactaatcgcgaccactcttggaagtcacttcctacatttctgccaacaagcaaccttgaccggattttgctaagaatttacaaggagtccactcatgttttcaatagttttgcgtcacaaaacctgacatcagcagttccataatgacaccaaagcccgtttgtaagtttaatatttaacctaaacacaaaaaaagagtgcgtcactcaataatcaatgttataatttctaacatcaaatggtatggataggggttgggagtatgaacgctgcaaattcaacgtttttagtgttatctagtatattggtattattcatgacgcccggattagcatttttctacggtggcttagtttccaaacggaatgtcgttaacaccatgttatccgtcttcatgatttgtggcttagcaatcttgttatggctcgcattcggttattcactatctttttccggtgatttaggtggcctttgtcggtaatctcaaagccacttggttgcatggtgtggacttgaccgcgcttaccgcgacaaagattcccaacggtttatatctcatctttcaaatgatgtttgccattatcacgccagcactatttgttggcgcggtggtcggccgtatccgttttaaattcttattaaccttcatcatcttctggtcactcctcatctactatccaatggttcatatggtttgggataacggtttattagctaaacttggcgtcatcgacttcgctggtggcaccgtcgtccacatcaatgccggtatcaccgctttagtcttatcagccttcttaggtgcccgccacaagtatggcaaggatatgacccagcactataacatcttatgggtattgctggggaccgctattttatggatcggctggtacggtttcaatgccggttcggcgcttgccatgaacgacatcgccatccaagccttcttaaccacgaccgttgccaccgcccacttccatgatgacgtggatggtcgttgatatgctaaccaagggcaaaccaaccctagtcggtgtctgcaccggtaccctttgtggtctcgttgcgattacacccgcttgtggctacgtcaccatttctggcgccttttggattggccttatcgccacattaaccagttacggcttcattacgttcatcaaaccacgcttaggtatcgatgatgcactcgatgcctttggatgccacggtgtttccggcatggtcggcagtatcatgactgggctattcgctagcaaagccgttaatcgcacaatttctctaaacggtcttttctatggtggcggctttaaattattcggattacaactattagcaacgatctttaccattggctttactaccatcgtttgcatcgtcattatcgtactattgaaacgagtcatcagaatgcgcgttgacgagcaagaggaagaactcggactcgatcaaggcgaacacggcgaaagtcgctgactacaccgttcaaatgagtcacgacttgacgaacattcaacaccatagcgatgaatttcgtggtcagttagcgcaactgctagataagcaacaacgattccgataatcggaatcatgggcgtaatatgcacaggtttcagtgcgttcgagaaagcagtcgcatggcacatttctatcaatgctcagtatcacaagcgggcataaatcagacgggagaagactgaggattagcctaactagggaattaaacgacgagtttggcgtcataacggcgctaatccgagttttttcagtgaacttatgccctggatctttaaaacaagcctgatttaacgaccccatttcagcaacatcaaggatgcaagaatataaaaacgtgtcgcaagaaatcatctcagatttctcgcaacacgttttttgatttactaatgtttacttggcgggtgccgtgcgtcgatgttttagtaaccgcccgccagtaatgaccgtcgttccaactaaacaaatccctaacgagaccatgaacgcaatgtgcataccatcaataaagatctccgggtgagctggcgggtatgacgtaaccttataccccgctgattgactcattgccgaatatagtacggtcgtggcaaccgaaattccaacaatcatgcctaattcacgtgccaacgcgttaatcccgccagcaacgcccaagtctttgaccgccactgaactcatcacgatcgaattattaggtgccatgaagataccattgccaaatccaactaatccgacgaataataagaagaaccaaagtggcgttgctagccccacaaccatgtaacccacttgactgattgaaatcaggaccaatcccacgaacgttaacaattccggtccgatcttgtcagaaatcgtcccagcaatcggggcgaccaccacttgtacgattgggaataccatcaaggcgtagcccgcatagtttgccgctagcccccgagcattttccaaaataaaacggggcaatcacgttaaagaaaaagttcgcaataaaaattaataacgcacataagatactaatgctaaaacgggcattcttaaataattgtagcgctagcagcggattttcatgacgtaactcgacgcgaacaaaaataatcagcgtcacaattgccactgcaaacaaggctaagataaccggctgcaagaacccaatctgttgcccgataaacacacccgcaaatagtgcaaccatgagtacggcaaatagccccgccccggtcttatccaatggttgttgcgtcgtcgtaacgtcttttggcaaaatcattgcacctaaaatcatcgccaagattcccaccggaacgttgatccagaaaatatagccccagctcaaatgagctaggatcaaaccaccgataccggggccagcaatactccccaatgcaacgaatgagccaatcatacctagcgcccggccccgttccttaaacgggaaaacttcggtaataaatcccgttgttcgtactcatcgtcattgccgctccgactgcttgaatactgcgtgcaatgagtagaaatggcaaccccacactgaatcctgacaataacgagccaataatgaatagtaaggacccgattttaaacacccgaatcttaccgtaaatatcacctaatttaccaaataataacaataacgcacaaatcacaatcaaataaattgagacgacccattctgcctgattcattggaatcgctaaatccttactcatgactggcaaggcaatgttcacaatactcccatctaacgttgacatgaacgtaaataaacataccgcaaccagtatccaccagcgatgcttttgaatttgtggatcagtcgcaaacgacattgttttcatcccttaacttcccctccattgcgcaactggcggtcaagccagtctaattgtgcttgggctcgtacccgttgtaactcattgaccatcaacgcatcttgaatatcagcggcgaaagcatgtgggtattcgtcatcacccgtttgtgctgcgccgttaagcgtgcgacctgtccctgtgcaaattgctgaaaatccaacaagattacttgctgctgatcacaacttaataaatgtaaaaattcagctttatttgaaacgttaactgcgtttgcttattgagcgcgactggcgtcataactaattgccaaaattgcgtgcgaccagccgctgttatcgtggctaacttttgtggccgtttattagtggtccgcttaaacgccagtgttaattcttcagccgcggctaacttatctagcaacgggtacaacgcaccaaaactaatggttaattctgaaccgactacgtttaccagcgctttacgcaactggtagcccgtcatcggatgatccatcaactgtcctaaaataaacaattcatacattaaattcaccaatccttcgcgctgttaagtatatatatcttttagatatatttcaaggttccaaactgattttttaattatgcccctccgttaccgaataacccagttcacgtttaatgctagattaaaacggctaaacatcagtgcttctcaaatcgatttttgggcaaaaaaatagcacctctcaggacgacatcatcgtttgaggtgctatctcatttaatcatcacttatgtttcgattttttatctttaataaagaagtacccgaatactaacatgaccccaatagccggtacatctaacgcattaaaggggttctgaaattgcggtccggccaaaatcaccagtattgcgacaaaacatagcccaattaaccaccacccgtatttttgaaagaaacggataaaggtactgtctggaaatttgaatttgatatattgtaataccaatattaatagcacataggcgacaacatttaagaatagtggcgtatccatgatatgaccccctttatgctctagtattaagataacccaccaaatggtattccaggcggaaaataatctaaattttcttataacgaatataactagattgctgaagcattacaaaaatcaagcttaatttaacccgaaaccaactcataaattgtgcattgaagtttagacattttcctttcaaatcggtagtacggtcagcccaagctcgtcccctcgaataaaagcatcagcgtcccccagtccgaataatgtgcgacgttgtattgtactttattccaaccaaagccgtcttgaatgcacacaaaaaatgggtgattgccatcgcaatcacccatcgatattaatgttaatttaatgcaaccactaaccagccgccgtcacttactattgaataagactgactgacttttaatataatgattgactggatgtaacagtactgtcggattctcaatcgccgaagtaaccgagtgacctgaaacattcactaacgcaaagaagacgaacaggacaattgccactaacatgacgagcttggtggcaatcgtcatcttttctggcaagatttgcttgtatagcgtccgatgaacttgacggctaactgcccgcttactcttatcgctatccttagccttttcttcgactaattgtcgttcataagcgacaatgtcaaagtccgcttgttccttcttcttaccgacctgatacttcttacgataagccgccgtttgcgctttgaaatccttagaaaatttccggtaatgatcaacagtttccttggtctcgccgacttctaaaagatccccaaagtgcatccaagcgacccggtcacaaagcaattctacttgccgtaaattatggctgacaaagataatagtcttcccttgcttcttgaattccataatcttatccacacatttttgatagaaggtgtcatcaccaaccgatagtgcttcatcaataatcatgatgtcgggattgatatgcaccgcaatcgcaaatcccaatcgtgaccgcatcccggtcgaatagtccttaactggttgaccaataaaatcaccaatatctccgcgcgaaatcaacaatatcatcacgaaccgcttggatctctttaatactcaacccttgcatgagtcctttcaaccgaatgttttcatcaccggttaaattccactttaagccggctccgattgaaataatggacgtatcaccgtgcacatccactgtcccagtcgtttgaggaatgattcccgaaataatattcgaaatcgttgacttaccagaaccgttgattccgataatacccaacgcttcacctggtttaacgtttaagctgaccccttttagcgaccaaaaccgcgggacatcaacattaccaatgttaaaaagtgttttaacttatcgttgttactacgatataaatcatattctttagtgacattatgcaattcaaccttatattgattttccatcagttccgcctcctaaatcaaatccacaaagttcgaacggaacttgttatagagatacgttccagtcagaatcacaacgagattgaagagccaaaagacaatcgtcaacgtgatattaggctgttgccagatccaaccacgattaagcagcgattcccgcattccgttgagcacgtagtagaacggatttagttctagtaggcgcacaaaaactgcggggaagttagacgttgtaaagttaaatagcaccccactcatatagaacagcatccgcaatacggattgaagcgtgatatgccagtcacgaatcagaacactgaccgtggcattaaaaatcccaagtgaatacattaatacgatcatacaaccaaagtagtagataaattgaatccaagaaactgagggccaaatgccattaacgaacatcaggaagattccaaaagcaatcatcgtccagaaactatataagttaccataaattttaattgacggtaatacgttgactgggaatttcatctttgaaactaacccaacctgacgataaatgctagaagacgcgtccagcgtcgttttgttcatgtataaccatggtgcaatcttccgacaaccatccatggtaaatacgggattcctggcatcggatcgccacgttttaacgcgaccccgaatactaagtaataaattccgatttgaatcagtgggtttagaaattcccacgctaacccaaggtaatggctttggtatgtggcccgatcatcatacttcgccattcgccgaataatcttgaaattggcgaactgatcgccaatcgtcttaaacatcgtaaacatagtgcactccttaaatgtatgtcgcaacacgatcaagcgcctcttgaaaggtcatgacagatttacggtcaagataaaccgcagactacattataacgataaacctcgttaatagcaccgaaaataacatttttattaaatatttacctattatcaatggatacttattgaccgatactcctatttcacaagcaaagaaagcccttacatacgttgtgttttaaaaacccgtatgcgtttattttggcaatcatcatttgaatatcgagattgcactttaagatcactagccgtgaacgcatcatcggaacactatttttacgtagcgatgaccagcaccgtgttgtgttgcacacataccaaacagccgcactcaatgccggtgacagcgtccgggtgcaagcgaaaacggttttaaatttgcagaacaaggcccttctaatgagatgagcgacctgaatagcacgtgagcatccgtttacttacctagtcataacacacttaccaaaccagctgaataatgacttataatggcgtcttcacctcaaaaagtgctatgatgagggaacattaactaagggggttagacacgatgagttcaattattgagaatttacaattagccgcacaacaggttcacctcatcaacctatatcaagccaatagcgaagtggtttacaccggctacatcgaccgtctggcacctgatggcgttgtcgtgaatacttacgatgatgctgggctccaggacggcgccgtcttcatgcgcattacgacgtcattgatgaagttgaaatgatgagtgaagaccttgataacatggcctttcgccttgaaaatgcaactactgaaggtttgaacagtgtgccacaaccaaccgtagctttagacgatcaacggccagtcctaacacagttagtcacccaagcccaaaccgatcatcaagttgtgctactagtcctcgaagacaacgaaaattatttagaaggtcaggtccaacaagtcactgaccaaacgattacctttaaaacttttgacaaatttaactttaaaaacaacaggcaacaggaaattccattggctgctattcagatcttagagttttgcggcaatgagctcttattggaaagcgcctttgtcaagaccatccatacgcatcgagcaaccgtcaaagtcagcgagtttgacgacgttgatcatactctaaacaacgccttaaatgagcaccaactgattgcaattcggtcagcggacgggtctgacatgttcttctttgttggcttcattaacgcattgaacgctgatagtgtcctcgctcaatctgatcgatatgacgggccaatttggggctacaccctttgtcgccgttcactaattgaatcggtgacaacccagtccgactatttacaaacgatgcgtggctttattgaattaaatcgccagtatgagttaaatgttcaacccgtcttaaacgacgaacggttatttgacgccacaactgatctttttgattcaattttgcgacaagccgcaactttcaataacctcgttcacatcacgacagaaaaccccatgttgccagcaatgactggctatccgggaacgttaacgaacgggcacttcatcttctataacgtggatgatgataatcaaattaatcatgttggcacgatgatcgaactcgatcaggtcgttgaattatcctttgggtacatggacgcgtacctgttagagaagcggttaaagagcaccggtaatttataataattttcaataacttgaatcaaaataacgcaactagcattcacatgccagttgcgttattttgataccgttattgcagttcaatatttccaagcaatcaagaacgagttacgaccccgttatatgaatcatgctaagcaagtgactgactgtcatcattaatgctaagaggcatcctaacgatcgaataagtgcagttttgcaattcgctgacaagcttccgtgaagcggggttcatcaatcaagagtccaacgcgcacatagccttcgccacccgcaccaaagccgtttcctggcgccaccgcaaccgccgctttatccaacagcaaatcggcaaatgcttcactggtataccctttagggactggcatccaagcgtaaaatgagccccctgatgggtagggctcccacccaatcttgcgggccgccgtaaagaactgattacggcgtcgttcatacagcccaaccagttcgtggaccgtctgttggtcactgttcaaggctgcaatcgctgcatcttgaatggccggaaagacgctaacaaacagatgatcctgaatcaaatttaaggcttcaatcatgtcagcattaccagcagcaaaaccaacgcgccaacctttgccatgttaaaggacttagataacgtgtacatctcaattccaacgtctttggcccccgatgcctgtaggaagctcactggtcgctgaccatcaaacccaattgcaccataagcaaagtcatgaacgataccaatctgatgttcatttgcaaaatccaccgtgtcttgaaaaactgcgacgttgcaacagcaccagtgggattattcgggtaattcaggtacaacagcttggccgccgcagccacttgtggatcaacccgctgataatccggtaagaaatgattgtccgctgttaaccgtagtaaagccaacttcacctgtgccaacgtaataccagataaatagtctgggtaaccggggtcaggtaaaatcattgtatcgccccgggatttagtaaggcaaagggtaactcgaccaacccaatcttactgccacccaaaaccgcaatctcagtctccgggtctaatttcacaccgtactcgcgttcgtaaaaatcagccgcggcttgtttgaatcgcggcaaacctcgaaacaacgaatacttgtgatccgcgggattggcagttgcagtctgcattgctttaacaacaaactcaggggttggttggtcaggattgccttgacctaaattaatcacatccgcaccggccgccgctttggcattgacctttttgaccagattcgcaaaaaactgttttggtaattgctgcaaaattttggactcttcaaatttcaaaattagtgcttcccttctgtcaatggtttcaggctcgtaatatcaaacgtcccagcaaattcggctaagtgaacaagattccgcaaaaaatcatgggtcttagcttcatagtggtattgcacccctaaatcatagagataaccattgatatataatcaacttcagtgggtcggtgttttgttatatcttgatacattgacggaaagtgcaacggattcgtctctcgactaacgtattcaatcgtctgccactcttcttctcgagtattcagtaacgtgatcccggcccgttcacaaacgtcaaacgcttcatcaatcagttgccggcctaacttttgagctactggcgactgaataaactcgcccatttgaatctggaacatcgtgcacaacgtgttgataacggaattaaaaatcacctttgccaataaggtacctaaaaagttcgtcgtcaaagtcggattcaggtgtgctttagtaaattcggcaacgatttgatgggtcatttcgtcaggttgttccgtttgatttgcaatattcattgaaccagcgtttgccgccccgataaagtcgacatcaccagcttgctttaagaccgtcccaatcaaggccgtcccgcccaacaccttcacaggcttgaagtattgattgacaattttttcaatgtggcccataccattcatagcggtaaccacgtattgctggtcattgaagaagtgtgctgattcgaatcggaaccaagtggcggttttgaccatcacgagcaacatagacaccaccccgctgttgaattgtttggacccgctgatcccaagtatcgacaaaatcaacttgatagccagctgcttgtaataaaacaccataacgtaatcccatggctcccgcacctaataccgtatacttcatgtttatgcttcctttcctgactatgaacgcgtgtaatgatccgcaagtcgatcaccgcaccactgaacaatttgcacaatcacaattaaaatgacaatcacactgactaatacaccggtattataacggttatagccgtattgaatcgctaagtccccaattccaccagcaccaatcgttccgaccatggccgaatagcctagcaaactgatcaaggtcaaaacaacgccacggatgagtgccggcaatgcttcgggaaataggacttcctgaaaagtcagccagaagctcgcaccagttgagcgtgctgcttcaacaacgcccgcatcgatttcggcaaaggccccttcggctagccgggcaaagaatggaatagcggctaccgacaatgatactgcgccaccaagtggtgtatagggatcaccagccactaatttggcgaacggaatcaagacaaccattaaaatcaaaaatggcagcgagcggatcgcgttaataataaaaccggccacactgttgataagcgggtgcgaggcaaatagcggattagaatagtaatacagtcctaatccaataatggtaccaaagacgattccgataaagcctgagataaagaccattttagccgtgtcccacaatgctgttccgagattttgctgtaatatagtccaagtttcattcatttacttgcacctcctccacataatcgacgcgtcgctgaaatagcgcaatcgcttgcttaacggccctgagtggtacccgtcaaataaacggctaataccccaatggcccgttcttgaataaactcgatccgtccctgaataatgttaatatcaatatccgttgccttggcgatttcagtaataatcggggttagtgaatcactaccacgataacgtaatgctaataactgaccatctgcgcgtgcgagctgtgcagcgactcttgtcggcagttgtgtatctaggaaccggttgacaagccgttgccccatatcggactggggcgctgcgaacaggtcatacgtgctcgattgctccactaattggcccgcctccatgacagcgacccggtcaaacaagcttctggccacttccaattgatgggtaataaagacgatcgtaatatgaagtcgccggttgatgtctttcagaatctgaatgatttcttcggctgtttcaacatctaacgcactggtcgcttcatcacacaataagacatccggatcattggcgagcgcccgtgcaataccaacgcgttgtttttgaccgccagacaactgtgccgggtaattgtcttgacgatctgcaagtcccactaacgttagcaaatcttgaatacgcgcaggctgcgctttttcaggatagccgcccgctgtcagggcaaacgccaggttctgtgcaaccgttcgattaccgatcaggttgaaattttgaaagatgaagccaattttacgccgcacggacgcaatctgacgcgcattagctttggtcaaatcatgaccatctacgatcacttgtccctgactcggtgcccgcaaataattgattgttcggactaaagttgacttacccgcccccgacaaccccacgattccaaagatttcacctttctcgatggttagtgagacatccttaacagcgtgcaccgtccgcttcttctgctgaaacgtcacatcaatatgttttaattcaatctgactcatgcccttgacctcctattgccatgaagctggtttatcgaaatccttaaattccgactttgcaatcgcccgcttaaaagcagcacttttgagaaccgctttgacagctttgccgaacttagaattgcgttgactcgtcttgacaacaaagacttctttgtaatcttccttgagcttttcaagtgccagcgctttcgatggtttcaacttagcattccaggaataattaccgggaatcaaagcaatcgtcacgttactcatcgactgtggtaactgggctgcatccaaggtcttgatcttcaactggtgcggattagtcacaatatccgccgtactagccgttgcgacgttgatatttttcttcaaagtaattagtttttgcgccgctaagagttgtagtgctcgagctaagttggacggatcattcggtagcgagactgtatcaccggacttcaaatctgatagtgccgtgatcttcttcgagtaaatccccatccccagcgtgggcgtctcgccaatggccgataacttcaagtgattacaggctttagcgaaggtcttcagatacaacgtatgttgaaataaattagcatcaatttccccagaattcagtgccttattcggttgaacgtagtcgttgaattcctttgtaacaactttatacccctttttctcaagtaatgggccgataactttagtcgccatatcaccataaggccccggagcaaccccaatcttgaccgttgtcaacttaccctgacttgcttgtgaactactggcacggctgaaccccacgatagccaccaaaacaacaataatgccacctaaagctaacaaccactttgtatttcttctcatcttccataccccgtttctcactttttacatgacaaaaagtcgtccctgttataacttataacaaggacgactttcgccgcggtaccaccttaatagcacccatttggacaccaactcatgcagaactaactgctgcgctaacgggcattaaccgcgaccacttaacatcactgctcaccgatcgtttcattaggaaagaccatcttctcaacgcttgctgggtcatctttcagcacttgacgactctctgttaccagctcaccattgatactcatctctcatgatatttcacattatgagtttttggttagattatgtcaagacttttattaatattaaattagattgaataaactagcaccatcctcacttttactgacacttggactgtacttctctctcatcgattagaaagtaaaccttgtcatgcaaccgacaccgcgggttaaatggccggtgacagtgcgggcattgcccctcatgataccgatcaaccgtcattcgataacgacaagcaccacacatcacggctaaatccgtcggagcgctggccacaaaagtatgctggcacaacgtatcatggcaccggtaacacgcgtaatagtgttgacatcgccgacaccacaatgccgcgatatcagtttcaaggtgataatgttggcaccgaccggcagcgtctaaaccgtgatgccgtaaatcactggtacccactcagtcatactggtaaccctaccctgatcacttcaccactcgtaaatgtccgccgctccccggtcaacatgcggaccactaagccaccatgttcatcgatatcttcagccaccccattcaccacggaatcgcccacttgaagtgtcacttgttgacccaacactaatgatttagcccgatatgctggcaaaaagtcggccgtagcgtagcgttttgatagcgctactagtgctgataataaggccgctgctaaccgattgcgatccactgacatgctcgggtcgaccgcttgggcacgagcttgcaattcccgtggaaaatcggtggtcgttaaattgagccccacaccgacaataaaggccgttgcggaagtcgattctaattccaaacttgcttccgtgataatgcccccgaccttatgctgatcaagataaatatcattgacccatttcaacccaaagttcttattaggataaaattgctgtaaaacattcaagacactcaccgcgacaccagttgtcagtaaacccacattgaccaatgcattcgtgggattaggaacaaccaagctaaaatacagtccagttttggccggtgaatagaagtcccggcccaaacggccatagccagccgtctgttcgtccgcgaagaaggcggcaaactgtggctgatgatgacttaaaaagctcttagctagaatctgagtggacggcgtctgggcgaccacttcaaggggccccgtaaattgacgttgcccatagatttgaatggctttggcatccaaattacgacttcccagataacagtagccccggtttttacgactctcaatctggtgtccttgctttctcaaagcattgattgccttccaaatgctctcacgactacagccaactgattgggcaagctggtccccgattgccactcaccatgatgacgcaataaaattgttaagacctgttctttagtttgggtcattatgacctcctgacccgccaatcacattagctatttactaagctggcaatccaaaatcaacgatggcccgcacacgccgggcaataaatacggccaaagtccctttaatgatgtcaccaggaagaaaggccacgttcgacagcaaggcggccgtcaaagtcatatgagactgaacagctaaccaactagcaccgattacatcaacaaataagataccagccaaccagacaatgccaacttctagccaccaataaccacttgtcatcgcccgagttattttgatcaacgttccaatcagcattggtgccagcaaccaagcaacgagatagccacccgttggcccgagaaaaatcgcggcacccccacgcccccagataataggggtagtcccagtgccactaatcctaagaacaatccaactgcgatcgtcccatatttgcggccaagtaactcggcggctaaaaagatgcccatattctgcaacacaatcggggacgggaataaagcccactggaattcccggaaagaaacctaatacaataatcaaagcggtcaccatcgccgtctgggtcaggtgtttaatcgtctgtcgattcgtcatcatcgcacccctgttaatcaatttaaacgctattataaaacaacagtaacccaatatcaacatcatgggttactgtttagaaaaaataaaaatcccatgaccctttttactgatcatgggatgattgaactattcttttggaatacgcttttcaacgtgatattgacgtgcttctggtcttggcgtatcggctgtcagtaagtcatccgcgtaaaaaaccgaataaccgtgatcctgttctagcggccgcgcaatcatgagtccgcgcttacgtccgtgacgcgcattataaatatccgcactacggagcgcttcattgtagtcatgcgattctgaaattgcgtcaccaggattaaataagacattttcatccatttgccatcagctccttgtcctcttaataacctaattatacacgctgataccgtcataacgaaagtttaaagattgatatcaacattataggttagtttcgagagcgttaaacctttggtgactaattgaccaatcaaagcttgggctttatcacgcatctttgcgaccattactttatcttgttcagtcaagaaagccgttaactcgtcaccagataacttcgccgcttgttcatcggtcgcagccacaaattgacccagttcgattcgacattctttcaaataatcaatatcatcctgaacgaaatcagcatagtgtgattcaacaatcattgatagtgtccggtagagccagtaagcactattcatatcatgttttagtggtgtgttcgcaaaactaggatcagtttcagaaacgttcgcatggaatgggaggtatggcgcaaaagctggtaccccaaatgtcatccacataatcgcgctttgttctgctggtacgtcattccgcacttgcataacgtgtgaattctgcgtccgattcattgaaattggccgaaactttttagcttctggtgtattcaagaagggatcgtacttcgtttcgttataatgagaacccagtacaaattcaacgtcggcaactgaaatcttcttggctgcgtgacaaatgaacggtagctcactcgactgtggatcttgttcgatctctggattgaaataacgttggccgtaccagacccggggagtattataatgccggtctttttcattatcagtaccgaagatatgacggaagttaaaaccttccttgtcagggttcaaatggtgttccgcaacaaattcttgaataccatcagaccacataaagttatcgggatcatcaaaatcaacccattgaatcgcaacttggttggcagccaccgcgtaagcatcatccggaatccgttgtgcaacccagtggtgaccagtgacgatctccatgtaccacacatcatctttatcattgaacaaaacacccgtttaccttctggcgaaccatatttagcgatcaactggcccaagtattcaaccccaccacgagcagaatcaatgaacggcgtgagcatggttggcaatgaatcttctgcgagaccattaggcacgaatgggtcaaaagtcagcgtatgttcattaccataaacactttcagttgaagaaacaccaacgtttttttcgttaaagccattttcttcaaaaacacccttttcagcgacttcaatgtttggtacagcttggtaacggtagccatccgctggaagtggtgcggtaaagccattcttcccagaagttaacgtttcgttgcgaccatgaacggcgggatggacgataaatttttgcggtgtaatcggcataaacgtatcatcattgcgggcaatcatcgttgaaccatcaacggtcgccttcttcccaactaaaattgtggtacaagcttgttcgtacatgcaagcatctcctgtctttaatttccgtgatcattattactatgatacacgctctaatttaaaaagccaccattgcgaaaacgctgacagataattcttacgcaattttaattgccgataaatttatcaatagtcataaatcttttcgtaatctaatcaataattcttaaatttgaaaaatcatcgtcacattttcttcacaattcgttgttaatatgtatctatagcaattaaggatccccctccaagattgctactataataattaacattcttttcatttactcctccaaagtaatgaaatctgtcaaagcgtaacaactttgacagcttgatgagcggcatgtgaacgtcccccgcttatatgaataaacgctcatcaagttatcagcatatgattccccgtcatatgctgacctactcttttgaccttcgtattcccgtacgaaggtttttttgtcggcttaaatacttcaagcgctcctttaactccgtattactgaaccgccctctaaaacgagcttatccaaatagttactgaagcgatatgcagcatgaattcaccatttatcgccatactttatcaacaatccaaaactcacccactattttataacggccctatcaatctaaccaaaaacagcatataatttaattattatcacattaaaggtgggtcatctatgcaagagggatacttagatcagcgcttaatcggtcagcgcttcattatcaaaccgaccgatctaactgacggcgtcgcattctatggcatcttgtaccatttgcacgccgcaacaccattgcacaccggcgataccgttgaaatcacggccgtcagtgctcatggtctaacggtaacgattatcgcaccacaacaataggggaaattattatggtaggtatcatcgttgcaattattgtcattctactggtcgttttagtcctaatcgcttccatccgcatcatcacccaaccgaaccaaggtgtcgtcttaacatttggaaagttcgagcgcgtcattagttccggctttcactatttattaaaccgttcatctcacgtgtcatcaccgttaacacggctcagacacccgttgatcttaatcaacaagtcgttatcaccaaagataacgctgaaatctcagttaagatttcgcttaagtaccacgtcactaatattgaagacttcgtttttaaaaacgaagactccgttcgtagtatgattcaagatacccgcgcggcactgcgtggtatcattgggaacaaagaattaaacgaagtcctgaatgggacgcaagaaatcaatgccgccctcttcaaggagatctcctccgttacggcgggctacggtttaaacgttgaccgggtcaatattgattccgttaacccttcggcagatattcaggcttccatgaataaactcccgcaagctacgcgggaacgggatgccaccatcgcaactgctgaaggtaagagtaagtcaatcacactggaaaatgaagccaataaccgggccttattagccaccaataaagccccaaaacgaagctttagtgaatagtgcaaaggcgaaagcaacagccgttcaaactgaagcagatgctgatgcttaccggacgcggatcttaaacgaagccttggcacaatcatccgaaaactactttatcttccaaaacacggaagctgtcaaagccttagcggacggcaatgccaacaccgttgttttaccaaaccaaacgttagatagcttgggcttaatcccagcactcaccaaggtcagcaaattaacaactaagtagcttttaatcaggacaaacaatgcacagcctgcgggttgacgaacgccaccgcaggcttttttctgttcaatctaagacctaatcaattttgtaaacctttccgttaggtttaagcgtgcaactaggttagaattagattgtgcaaaaccatacttagaggtgttaatattgaaacaaccttggcaaacagcttggccggaacgaattagttatgggctcagtgatgccgcggataacttttagtctttcagatgatgaccacatacttattattcttctataccgatgtttacggcctatccacgagtgcagcggcgattttatttgtcgttgcgcgcttagccgatgtcgttgaaagtctgattatcggcgtcatgattgaccatacccattcgcgcttcggtaaaagccgcccgtttttcttatggtacgcgttaccctacgtcttgttcgccgttttgacctttgtgaccccgaatttcggagcaactggtaaactcgtctgggcttatgtgacctatttagggttaggattcttctataccgccgtcaacctaccaatcacatcgattttaccagcactctcccagaatgaacgtgaattaaccttactaggcgtgattcgtcaattcttcggtagtagcgttcaaattatcgtcgctgtcttcaccttgccactagttgctttatttggtcagggtgatcagcaacgagggtttttactgacaatcgttctattttggcattatttcgttggtactgatcctcaacaccttcttccaagtcaaggaacgctttagtcaacctgagcgtccgcaccaatcactcagtgcggtgtggggcatgctcaagcaaaaccagccgtggtttattttatccagcgtgattttactgtattggttaacaaccgccatcaagaatcaaacgaccatctactactttaaatacttgattcagcgtgaggacttagtgccagtcgttaacggctttacgtttgcgtcactgatcggggtcattttaattgtccggctagccaaccaccacgggaaaaagaataccatgttggcgggtatcgcaatcgccgctgtggggcaactgatccttggtctcgggacagccatcaatcaactggccttcgtcttcggtggtacgttgatcaatgctgtcggtaacggtctcatcattggtttggtctcaatcatgattgctgatacgatccgttatggcacggcgctgggaaattcaagcagaaggtattttagcctctactgatgacttcggcgttaatgtcggcttaggacttggtggcctagtcaccgccggactctttcatttaagcggctacacggccaatcatgcgcaaaatatcgccactcagcatatgattaccctgaactatgcgtggttaccattattactttacgtggtgatgtttatcgtattaatttttacaatgagcagcaattgcaagacgcgattaatgtttagttatccgttcttaacaccaaaatgaggtcagtgaccctcggcatgcgagaatcactgacctcattttttccttcattcaattggataccaacagcatcccattaagttaccgttattttagcaaaccgcaaaattaaaaatcacgctataatcggttccccgataatagcaaccagaaaaagggtacactgacactggcactcccaggtggtaagtcagtaccaagttccccaaaaaagcgcaggaaaaagcccgaccccgaagagtcgactttttctgaatcaaaaatccaattatttaacagctggagtcttgaaccagccaatccgtgatgtaacaacatcaacgatggccttcttaccaggtgccaataacttacgagggtcgtagcccttaccgatttggtctgcgccagattcgatgtaagcacgagttgcattggcaaaagcaacttggttttcggtgttaacgttaaccttgctaatacccaattcaacagccttaacgatttggtccttaggaataccagaaccaccgtgaagtaccaatggcatcttaacggcttctgagatttcttgaagacgatcgaagtgtaagccagtccagttttctgggtacttgccgtggatgttaccaatcccagcggctaagatgtcgataccagtagcagctaaagtcttagcttcttcaacatcagctaattcaccttcaccgatgataccgtcttcttcaccaccaattgaaccaacttcagcggcttcaacagagatgcccttagcatgagctaatttgacgatttccttagtcttttctaagttttcggcaaatggtaggtcatggccatcaaacataactgatgagtaaccaacttcgatacattccttggcagcttcgtagttaccgtggtctaagtgcataacaacaggaacggtgatgttcatgctttccatggtatcagcaactaagtccataacgagcttgtagccgcccatgtacttagcagcacccattgaaacttggataataactggggtgttagtgtcttgagcacccttcaagatgcaacgagtccattcaaggttgtttgtgttgaacgcaccaatagcataatggttcttgtatgcgtcttgtgtcatatcaacagcatttacaaatgacataaaataaccctcctaggttaattaagagatacgatttttgaatcacattcattttagcacattttacataggagtgataaccgatttgtcatatttgtattaaccaacgattccccgtcaattcttgcttatttgacaaccgcccgtttgtaaacccttccatttatataaaatcagttacagatcaagccaaaagttgcttcgaatttaatcaataattaattgtgaatattataacagcaatccgttcggtgaaaatgtaagcgaacagtttatttacatttatatacgctattaaatcaataattatagtgttttaaaagcaatttatgaaattaaatattagctatttacatttgtgaaaaagtatttataatagtgattgtgaaataagaaacaagttgattttgcataggaggaaccgtgaatgctgaaagaaatggaagaaacaaccgtatcacgttcaatcgatcggttagtcttaaatgcttcgttagctgccaaccgtcttgaagtcatggaccaaagtcaagttgatcaggctgtcgctgccatggcccgcgctgcccacgctgctcgtggcatgctggccgctatggccgtcgaagaaacgggtcgcggaaattatcgtgataaagttgcgaagaacgactttgcagccaaaaacgtttataactacatcaaggatgacaagacggtcggtatcattaatgacgatccagtcagtggcgtgatgaaagttgctgaaccagttggaattattgcggggtcaccccagttaccaacccaacatcaaccgtcattttcaatgccatgttagcattaaagactcgcaatcccattatttttggtttccatccctttgcacaaaaatcttgtgttgaaactggccgaatcatccgcgatgctgctattgccgctggcgctcctaaggattggattcagtggatcaagacgcctagccttgaagcaaccaacaccttgatgaaccatccgggcgtcgctaccattattgcaactggcggtgccggcatggtcaagaccgcgtattcaactggtaaaccggcactcggtgttggccctggtaacgtgcccatgcttcatcgagcaaaccgcagacattcaacaggcagtcagtgatgtcgtcacttccaagtcattcgacaacggcatgatctgtgcttccgaatcaaacttaatcgttgctgatcaaatctatgatcaagttaaacgtgaattaagtcacaacggtgtgtactttgtcggtaccgagaacttcaaggccttagaagcaactgtcatgaacctggataaacaggctgttgacccgaaagtagctgggcaaacgccatggcaaatcgctcagtgggctggctttgatgtcccatccgataccaaagtattagcagttgagttgcctagcatcggtggtgaccaagtcttatcacgagaaaagttatcaccagtcctcgccgtcgttcatgccaaggatactgaggccggcttcaacctgatgaaacgcagcctagcacttggcggactgggacatacggccgccttgcatacgactgacgaagctgttatgaacaagtttgccttagaaatgactgcttgtcgagcattgatcaacgtgccgtcttcacaaggtgccattggttataaatatgataacgtcgcaccatccttaacactcggttgtggaacatgggggcataactcgatttcacacaacttggaagattgggatctactaaatattaagaccgttgcaaaacgcttaactaagattcgctaaagtttcatcaatcaggataataaatttaaaattgccgctaacaaatgcgcccgctgaagtcagtctgcttaacttcaacgggcgcattttagatttatgaccaagttaagccaacttcttaaccgtccacgcatcgcgaaaacgatccggtcggtacagaaaccaccgccccaaactccaagttagataggcaacgaccagcgccattataatcccagtcgataatggcatatgcgcatgatagttatccgttagcaaccctaaaacaccgttaccaaattgtgaacagcaaattgcaactaattagataaataattgaaaagcccaggacggctccgcgccactgcggaaagcggaaaaaatccccactattttccaaagataaatgctcaaacgcccagcggttaagcaaatacaggccgccaccgataacaccacaaatcacccaagtggttagtaagcccccgggtttccagctcggcagctgacctaaaacatccactgctcatatttaagcttcgttaatcccgcagcaagattgatcaagccatcatatgcaaagggcaagctacaaacgaagacaaatgtcgcaagcgcactcgcaaagatatggccaacccataacccgaacgtagcggctaataatccaaacactaacattactgccaggattccaagttcttcatacaatgtcgtaagccaatcaatccgcaccgctgtttagccaacacgcgccaagcaatcagtccaaaaacagcttccgccaacatgtatgcgctgaccaacatcccaataagtaaaacccgatcttacgccgataaatttgctttcgagcgaccggcaaactaaataaatattgattaaaattcgtgaaattatcgcttaagaatagtgcgactcctagcaccagactaacgatgatggcgaccaccgtttccatccgaagatgagtggcttccatcaacgcaaaactactgacattttgtgcaacataccgtgacggattatgggcaatactgtagccttcctttatgcctactagtagtaagacaccgcccgccgttaataacaacgtgcgatagtggcgccataacaactgccataactttcgtttcgtcattttatcgtcccctaagataataattcaaagtcagcttcatccgtcagattagccataaacaagtctgctaatgagagtggtaaatcttcttgaaataccgggttagttgtcgctaattgcgcctggacctcagcattataatcttcaaacactaccacgataacccgaccagaaacgtgggtacaatatggcctaattgtttaacaacggctggaatctgcttgtcacgatacactaattgaacttttcgtgcacttcgtcgcatggcttctaattgatagtcattgacaatgcgaccgtgtttaagcatcaacgcgcggtcaataaccccctctaattcagccaaattatgtgacgcaatcacgattgaacggtttcccgtagccacttcatcaattagaataccaagaatgttttttcgaattaggacatccaaaccatctagcggctcatccaaaaagagatacggcgcttgcgtcgcaacactgagaatgattgtaaacaaaccaaacattcccttagagaaatggcgtaatttttgtttggacgtcagatgataacggtctaacaattgcgcaaatttggcattatcaaagtccgggtaagcagcttgataataccactggatttgcgcaatcgtcgcgcctttaaaaaaatttgccagtggatcaataaaacaccagttgcgtccgcatttccggttgatcaacaacctcttgcccatcaaccaggacctgaccatgatccgtgaggtactgcccattgattgtccgaaaaagggttgttttcccaaccccgttacggccaacaacaccgacgatttgaccaagtccaatctcaaaactaatgccatctaacgtctggtgatggtcaatgcgcttacttaactgattaatcactaaactcattatttttccccatttgatcaagccagccatgcaattcagcaatactgacgcctctttgacccgctagcctgacaatttgtgtaaactgttcccgtaattcttgtcggaacagcgttgaatccaccactttaacgtacgtgccttttcccggaaccgtctcgataatttgctgtgtctccagtcgcttataggctttactgaccgtattcggattcagcaagtgttgacgagccatttcacgcaccgacggcagttgttcaccactttgtaagacacacaccatgagcaatatcttgttcaataccggttactatctgagcgtaatacggttgtcggcttccatgatcaatttgcatggcccacctccatttaatacacagtcgttacttcgcttacgttaaatggtacagtatagtacagttataaacaagctaagaaaacgttaaaatcaggccacttgtacagtccaaacagtgtcctttagacctagtaggaatagtcctcagccgtcacgaaaaaagcccgtatctgccaatcgtggtaaatacgggcttctatatatacgtgctccgctaaacaagcacgatattaggttacgatctatttgcgagtcacttacttgcgccgtaattccgttgcggcgaattccataatcgccatcaacacaatcaaactaatcggaaaagcaatgacactaactgttaaactagccgtaatttcaaagaaggtaaaaattaccattaataacaatacggctgcaatcaacatgccagttttcggcttttccccaatgcttaatcatcgtgttaacctcatttctatttattagtcatcacgagtttaacatgtctgatatcgcttactaggccttattgctaagagttccatgagaattctattggagtagccgtgtcatcgtcgtcaccgctaaccggccaccggcttttaaaggtaagaacaactggttaccatcttcaaacccgagtttctgccagaatcttgcgaccccttcatcagcagtaacgcgcgttagttggatcgccgttatattcgcttgaagtgccgcttgcatcagtccggttacaataactcggcccactgatttacgttggtaagccttattgaccatgagtaatccaacgaataaaaattgttcttgtggatactgattgagtacatctaaaacggctactaaacggtgtgctaagtaaaaaccaaaaacctgtttttgtgccgccgctagctcgtccgggtgggccgtcaaatcatgttgttacctcagtcatcgttagtggttccggtgagaaatattggtgatagcgcggattactttgttccagctttagcaatgcttcctggtcagctaaagttagtaatcggatctcaaaatccggtaattgtgcttgtaatgttgctaatttcatgatttaatcccagactttctctaaattataccaagtttcaccagcatgttcggagttcgccacaccttgattaataaaaccattacgttcataaaacggaattagtcgttccaaacaagtcaacgccatgcttgtccgcccgtctgcttgagccttctcagctagcgcggtcaataattgactaccgatctgttggtgacgtgctagtggcgaaactgccaacgtgaaaaccagctgatggccgccacgtggcaagttagtcggtgtctctacaaacatctcatcttcaatatagcgggcaccgacagctggtcccacgataaagccaagtacgactgcaccatcgcgcgggcgaccagaaaagtatccgctaatttctcaatgcgttcgcgataagcagcctcgctgccagcctctgcttctgaaaaaccagatttttcgatcgccatgatttgtggtaaatccagcattttaacaggtgtaatttccattgattttcgccctccaattcgtacgtatattatagcaaatgtcggtcaatagttgactaacttaattttccccgaaaaaccagtgtcgaacgtgtcgttttcagaaatgtcatgctatacttgaattgtgaattcggttacatgcattcgaattcaataattctaatcgaaattaggtgacctttatgcccgctcaatcagcagaacaattatggcatgcttataacgaaagcaccgacacaaacggggcttcttatcaaacacgttggttcggtcaacaaaataaccccgcctgaagtgactgctttagccgacgcaattctggctgggacgaagacagcgacaaccacgccgctggcacagttataccgcggaacaaattgccattccacaagttggcgactacaacgtcttgctaaatggtgacatgaaaccggtcgcgattctgaaaacggtggtgtctgaactcattccgttttatcgcatctcggcggaacacgcttaccatgaaggcgatggtgatcgcacaattggtgattggcgcaagcgtaagacggcagaattcaccccgacgttagaagaacacggcaaaaacctctcatcggacacaccgatggtcagtgaagtttttgaagtcgtttaccgcgcggattaatcaacaacgctaacggcctaagacggatgtcttgggcttttttattagagtgcgaggacaaccgggttgggactgaggattagcttagcattgatgttggctaggcgggcttcctagccggcagcaatgctgggctaaccgcaagacccaggttgctccgaacacgtttcgtctatattgcagtggcgatttttgcattgattccgttggcgtagcaagcgcggcttcagcggcactccacgaaaagtccgtccacaacgcacctaatttattcactaaccaaacgacagttccaacccctcaacaccactgtttctgggcgatttgaccagacaagctggcagacttaaaaaagaagctgccaattgtaaaaatgcttgtcaccacgtcatttttcattataattaaagctcgtactaaacttattgtttagtttaacaaaactaccgattcgaggtgaatgtcatggacattggtcaacgcatccgcaacttacggattcaaaagcaactcacgcaagaagaattaggcgaacgaactgaccttagcaaggggtacatatcacagttagagcacaatcagtcatcgccttcaatggagacgttcttcgcgattcttgaagtactcggttgtgcccccgctgatttttttgcggctgagcagcccactcacaaagtggtctaccatccagcagatcagaccacgtatgacgatgaagccttaggataccgtgtgaaatggctcgtacccgcgtctaacgaaaatcagttagaaccggtcaccgtcacactggcacctagtggtcgcttcaaatcttttgagccgtcgccggcagagacctttattatggttcaaaccggcactttaagcttacagctcggagctcagcaatatactgccacggcgggagatacgctgtacttccatgcgactaagacgcatcagattcgtaatcttggcaccacgtcccgcacgttcaccttggttacgaccgcgtcctacttataatcatgtcacaaccaatcgagctggtattaggttacactagcttggtacacgttttaaggaggtctttactttggcggttaatacacaaccaatcattcgattgacaaatgtcactaaaagttacggggaacatcaagttttaaaaacatcaacttagatcttgaagcgggcaaattctatacgttactcgggtccgtctgggtgtggtaaaacaaccattctgcgtaccattgcggggtttacggatgccacttccggtcaagtttactttgacggtcaggtcatcaacactctgccggccaatcagcggcaagtcaacacggtctttcaagattacgccctttttccacacatgaatgtcacggaaaacgtggcatttggcttgaaattacacaaagttcccaaggatgaaatcgagacgcgggtccaaaaagcactcgcgatggtccaactagccgatcttggggaacgtgaaatcagtgaaatctctggtggacaacaacaacgagttgccattgcccgggcactcgttatgcagcctaaggtcctcttactcgacgaaccgttatcggctctcgatgccaaactgcgtaaggatatgcaatatgagttgcgggaccttcaacaacgcctgggcatcacttttctctttgtcacccacgatcaggaagaagccttggccatgagtgtgatgaaatctttgtcatgaacgctggcgagattttacaaggtgggtccccagttgatatttacgatgaaccgatcaaccatttcgtggcgaacttcatcggtgaaagtaacattattccgggtaaaatgctcaaagattttgaagtagagtttgtcggcaaacaattcgaatgcgccgatgcgggaatgcagcctaatgaagttgtcgaagtcgttcttcggcctgaagatctcgacattgtggccgcagatcaaggcaagttagtcgtcactgtcgactcccaactatttcgaggcaattatttcgaaatcgtcgcttacgataccgatcataacgaatggctcgttcattcaactaaccccgccgcagaaggcgaaccgatcggcctgacctttgacccacaagacattcacgtcatgcggttaaacgagagcgaagctgcttttgatgctcgtcttgaacaatacgaagatgattaggaggtgtcaatatgcaaccaaaacaacgattaagtcgtaacaccgcttactttatcccgtacatgttgtggatcatcctcttcgtcattgccccagtcctattgttgatctatcaatcattcttcaacattaacgggcaatttacactgggcaactaccaaacgtatttttcatcaaatacctacttaatgatgacgctcaactctgtctggtacgccttcttgatcacactcgcaacattattgatcagttatccgacggcttatttactcaacgaaacgaagcatccgcagctgtggctgctcttaatcattatgccaacatggatcaacttattacttaaggcgtacgctttcatcggcatttttagtcaagctggcatcgccaaccagtttttaagtttcatcggaatcgggcccaagcaattgctctttactaatttcagcttcatctttgtcgcggcctatattcagattccgttcatggtcccgcccatttacaactcgattagcgaactgaaccccatcttacgtcaatgctagtcgggatctcggtgccacaaattggcagaccttcaatcgggtaattttcccgctgaccctccccggtgtgaaggctggcattcaagccgtcttcattccctcactgtcactcttcatgttgacccgtttaattggcggcaataaggtgattacactcgggactgcgattgaggaacacttcttgacgacaatgaactggggcatgggttcgacgatcggggtcgtcctgattattgcgatggtcatcatcatgtggctcactggcagcagtaaaaagcgcgcacgaaaggggttgacgaaataatgaccttacgtaacttcaagtggcgcaacttatacctgtggcttgttttcatcgtgctgtatgcgccaattatttttctagtcgtttactccttcagccaaggtacgactatgaacaactttcatggttttacctggcaacattaccaagacttattcgcggatagccgtttaatttgccatttttctcgacaccattttgattgcgctcttatcatcattattagcaactgtcattggcacgctgggggcactcggaatcaatagtacgaccaaaccgattacccgcaacactttgttatcgttgaacaatatcttgatggtttcacccgacgtcatcattggggccagtttcttgattttctttactgcccttaaaattccgctcggttttggctcagtcctgttaagccatattgctttttcaattccaatcgtggtcttgatggtgctaccaaaaattcaagaaatgagcaccagtttactggatgccgcggcagacttaggtgccaacaattggcaattactcagccaaatcatcgtgccctacatcatgcccgggatcttttctggcttcttcatggccctgacctactcactcgatgacttcgccgtcactttcttcgtgactggaaacggctttagcacgttgtcggttgaaatctactcacgggcccgtcaaggtatcaacctggaaatcaacgccctgtccggtctaatgttcctgatggcactggtgttagtgattggctactacttcattaaccaatacagtagtcggcaccggcggccagcagttagggggcggcggaagtgaaaaaaattattaagtatcatcgttagcttgctagtcgtctgtggcttactggcctttggcgcgcaacgcttgcagacgagttctggcagtactggcaaaaaggttttgaacctatatacttggggtgactacatcgaccccagtctgctcactaagtttcaaaaacagactggctatcacgttaacgtcgaaactttcgatagcaacgaagctatgtatacgaaaatcaagcaaggtggcaccagttacgatctgaccgtacctagtgattacatgattgaaaaaatgaaaaaagcgcacttactcttaccgctcgataaaagtaaactgactggaatgaagaattacgatccgcgcgctttatgaacttggcctttgatcaacacaatcgttactcagtcccatatttctggggaacgcttggtatcatttataacgacaagtacgttcagccgggcagtattcaacactggaatgatttgtggcaacgaaaataccataacaaaatcatgctgattgatagcgcacgcgacgtaatggggttcgccctcgcatcaatgaatcagtccatgaacacgaccgatccagccactctactggctgcgcgaaacaagcttaaccggctatcaccaaacgtcaaggccgtcgtagcggatgaaattaaaatgtacatgatccaaaacgaagccgcaatcgcggtcgattggtccggtgaggctagtgaaatgttggctggcaattcacacttgcattacgttgtcccatccgaagggagtaacttgtggtttgataacttggtcattcctaaaacggccaaacactttaaggcgatttacgccttcttgaactttatgagggtgaacccaagaacgccgcccaaaatgcggaatatatcggttacgcaacacctaatcggaaagccaaggcgctattacctaaggccattcgcaacgatcgccaattttacccagacaataacacaatcaagcatcttcaaatctatcaagacttatcaccagccaaagtcggcttgtataatgaccgttatttggaatttaagatgcatcactaatcggatcagcctacttgattcaaatgactggcatcaaagaacggtcgattataagctaaaagggcttgatttgaaacaaaggaaactctgttgatcagagacgatgaagttatatttaggattcaattcatctacgaattggatcctttttcgattctcgtcttgaatgcaatccgaattcaatcaataatttttaccggttattgataaacattttaatattagtcattagctgaggagtggtatttcctacattacctgggcctactttaaaggattgataaatcgctcttttcaaaattgtcataatcttttaacctttaggaatatataagagaaaacatctttgtcactaaattactaatagtggcaaagatgttttcctgtctagatattttgattatgaatactgcaactaaccatatctatcctatagttagatacactttctgcatatttatcatatgatacgatttatttgtattataaaccttagtcagcagcttcttgacgattactttgttcatcaagtaattgtgccacgtttatagtcggcaaaataagtgctggaaattggtttgatgcattagttataccggatactagcgaccgaacataagggtagagaatggcaacagcatttttcttgattaaagtatcaataccaacttgattatgatcttctttctcatgatagacaaattcgccactgacgctcgccgtaactataaatggatttttcttctccgccagcgatccgatatgcacatcaactgttacaataattttgtcttgctttggcgtatttttaatttcaattttgggatttatactaatattctggttagtttccttatataaatcgttttttctataactcaactcattaactgtatagcttttaaattctaaaactgccattatgcaacacctccaacaaattcttgaactttaaagattgtggtttctgaagaatcattagttttatagaaatatttggccgtatctacatattctgtttcagttaaaaccttagttaattcggcactatcactcgtatctgaatcataagaagtcaagaatccctgtttttcgtaatcttgttgtgcttttctaaaagagacttcttgtgaaagcgtttgaactcgtttattgttctctatctgtgatacttttgcatagctaatacctaatcgttcagaaaagacgcgctgacttaagtgcaaattttctcgtaactttttatttcatttggttgcatgaatccttttcgatttctataagcattaaaggcctttctaaaattctcattggggtcatcaaaatccaaccaaagttctcctcgagaatctttccagtaatgattatggactatcaagtcagatatgtctttgactcgcatgagttcgtatttccacacctccgaatattcctcagtggtatttaattcttcattgtaaaaagtttttttggccataatgagtacctccaagaacgtaaagtgaaaatagtctattatttaaaaggatattccaacgggtattcagctggatgagttgaaatccaaaatatgatattgccgcccttaatttgaaattttagataacattcaatattttcgatgtctattccaaagagccacacatctcctgggattctggggtggtgattatccgccattggaccattaacataatcgcgccatgtaatttgttgatatatactgtctaaaattccatctaaatccatacctaacgttactgctgctgaataattctttgcgcgatgactaatttgccagttgtttcttttcaactttatcaaagcaacaatcgctttggcatcttcctcttgagacattcaaaaccaactcacaatcgaattttcacttgtaataactatatcacaatgtgtttcccgtgggaaacacattgcacttttacttgaattaacaacaacagccattttggtttctaattttgatagataaatcgtactttatacgacacaaaaatagtgttgatgaattttatccatcaacactaaagattatagaccccaacagagtgcttcaagtcaggtcctttaatgtttaggcgcttaccgccatgtcagaccactaatgattaaaaatttaatattcgcgagcactactagcgctagcactaatcctaaaccgagccgatttagccaataacgatccgcggtggttggaaagacgataaattgtaagtttaaaatgagtagcgcgcaaaacgcactgctggccaaccaccaaagtgttgttagaaaacaaggttatcagtaagctgcccgctaccactagggtaaaccacggttgaattggtgttcgtattgatttagtcgtcattttgaccgcccccttatcatgccttcattgtaaggggtgcccgtaaagtatcgttagtcccaacagctggttacttaattgcccgaatcagcaaccagctgagccattcgacggttaactagtccaaaatagccaccacagaaatcgaatttctgtggtggctatttatcatactactggaattaatttaatgattaatgatataagtcaaaacgccctttactgaagaccgttcctaaatgcgcactttccaaaagtgagcggtcagtaataattttcttcaatgccgatgccgcgtaaccatgaaccggtttattactactgaagatttcaccaataccgtcacgatcgctcaatgaggccacggtcccactagattcatagtggaacgttgccgttgcttggttatgacgcaaagcgccaatattcttggcagcctgttcgccagctgccagtgcaatttgagctgtggttggatatggtcgattgctttcgggatccatcactgcagcgacatccccacaatgaatacttccggatgcccctccagtgataagtcgggcttaactacgacccggttacgacgttgatcaaaaccggaatcagcaatgacgtgcgaaccactgacaccaaccgtccaaataatcgtgttagccgtaaattcatgttcgttcttgtccgcgtcactgtaaaccacagcgcccggcttgatggcctcaataacggcacctaaccgcatttcgacattattcttttccataaacttcaaagcgtagtcccgcaattctgcgtaaacatcggtaaaattgatggcatccgttccaaacaaactaacttagcagcgggtgtttgatactttgcctcgcaatcttggtaacgtctgggtcagttcacctaataattcgattccagtgaacccagcaccacagaccgcaatcttcaaatcatttttgttcttactggtacggtaggctttaaaccgttcttccaaatgttcataaacagcctgtgaagttgccaaatcatccattggcaaggcattttcatcggcgccagctaccccaaatgtttctgactggaagcccaatgctaatactaagtagtcataggtcatttcaggatgatcttcaaaggtcacttgtttttgttcaatatcaacgctcttgaccgttgcttgaacgaactggacccgcttaccgataatatctggaatctgataagtaattcgatcaggtgcgatcgtccccgctgcgacttcgtgtaaattagtcttctccgtatgcgtcggtgtctgatcaacaagaatgatttcatcctcagttggtagactcttctgtaaaaacttgacggctcgcatccctgcgtaacccccacctaacaccaaagttgttgccatgatttattaaccccccttttcattattcctgttgactaatgccgcctgtccagcaattgtgctaacctgcgttgatcacattaatccagttataacttgataactacatggtacactcttcacgcctaaaattcagctaaaacgccacgccattttaattgttcacaattaatctagtttagtggttaaacttactcaatatgctgggtgacattagccgtgactaacgacagactttcaaacaaaacttgttgttggcccggcgttaactgctcaccaaccaagtctgcacaccactgctcataagcatgcaattccgggtacaacgcttgcccagcgctcgttgggtacaaacaccggacctttttattctctggatgtgtctgcttaatcacgtaaccttttttattaagttctgaacggcgcgataattcgtggttcgatccatcttcatttggtcagccaattgactaaaaaataggccaggctgctcacaaattcgaattaaataaataaaacctgattgttattgaggccgtatttcgcaaaacgttgattaccctcgttcgtgacgattcgcgacaacgtgcccatcaatcttaatgttggtatcatagaagctcctttttattattgcatatgcaatcatttgatgataaacttagcactatgctaaggaggcatcaccatgtggtcgattaaaacattctcagaactaacaacaactgaattatacgctatttatgaattgcgcgtcaaaacctttgttgttgaacaacaacgcatctatcaggaagtcgacgatactgatttaaaagcttatcatgtctttaaaaccgtcaatcaaaatattattgcatacgcacgaatctttacagaagatgaccatctctccttcggccgggtcgtggtggacaaaaaccaacgcggacaacacttgggcgctgatttaatggcccatatcgaacaggtcgtacaggaacactatgctgatttgccaattcaaattgaagcccaaggtgccagtacaaggattttaccagcatttcggcttcacttcgagcggtaccccttttctattcaaccacacgccccacatcaaaatgactaaacacgcgcgacaacgccaatagccgagcacatcacatcggcacatatgcggggacaagagctgacttagcgctatgctgattagaattcaaaactcaaaacgcgtgactcggaccacaatccgaatcacgcgtttttaattgactcatttattcagctttagataaccgttcaacgtcacgcacaatcatcagctcttcattagttgggacaaccatgaccgttaccggttcgtcatctttgctaataatttgttccttaccgtgcatatgattcttttcatcatccactgtcacgccaaagtatcctaaggctttagtgacacgttcgcggatcatccatgagttttcacccacaccagccgtgaagacaagggcatcaatcccgttcatttcagcaatatagctgccgacatacttcacaacccggttaacaaaaatatcaattgctaattttgaccgttcacgggtatcttgcgtcttatcaagatcacgcatatcaggtgacaaacctgaaataccaagtaaccctgacttatgattcagaatgtcaacaaagtcttccacatcagagatccctaaatggcgcatcaagaatggaataattgaggcatcaatatcaccggaacgggtactcatggtaatcccagctagcggcgtaaagcccattgaagtgtcgacggctttaccatgatcaaaagccgtgatcgaagcacccgaccctaaatgtaatgtcactaatttaagcgaatccaatggtttccccaatagttgggccgtccgattagcaacataacgatgacttgtgccatgtgccccatacttccgcgcgccaaatttctcataataatcgtaaggaatactatataggtaattaattttaggcatatccgcatacagcgaagtgtcaaacacggctacttgagtcgcttttggtaataaatcacggaatacttcaatataataagcctgcgttggattatgtagcggcgcatactcagataaatctttgatttttttcaaggtttgcgaggtaataacgacagagtctttgaaatcttcgccacccgcaacaacccgatgaccaaccccagtgatttcactaagatgagtcacaatattatcgctcttcagccgtgttaagaccattgcagcggcttcttttgcatcaatttggtccttagtttcagaatatttactaccatccgccttcttaattgtgaaaacggaatctggcaatcccagccgatcaaccattcccgatgcgattaccgtttcttcgggaacactgaaaagcttccattttaaagttgaactgccggcgttaattgctaaaatttttgccatgactatttttcctccatccatcatcaagtgtgcctaatgtcagtttaactaatagtggatacgctttcaaggatttgttcacaaactttcaattttcataacattgcaaacttaattatcggcatattatttctttcataaggcgaaattagcctataatatagttaatagaaagcgaggcgatcatgatgaaaaaaacgtttacttggtccgtcagtaacggctttgctgtcctcctcctgaccgtggggacaattcttgctatcatcactcttggtattagctttggttcaccaatcagtgtcgacgccatggtcacagcagcggctctgtggctagccggtgtcgtcttcttacatccagcccctgtgagaattctaattcccgtcatcacattagtcagtctcagccttggttacgccacctactttagcacgtccggttcatggttgcttgcgattttagcgaccattatcacagccggcatcatcagctacggttttagtctccgcaagagcattcgccaacaccacagccattggtacgattaacttcctagtctgattcattttcttctaaatcaaaatcgtcaatctaaacatcgcaacaggcatcggcgcccttatcgcgatgcttttttatttagctttcaatccagattgttaacccgtatcagtttttcaaaggcaaaagtgaccagctaagattcgctggaaaaaattcggaatagcatgcacccgtctggctagttcgtcctacattgactcccaggcattttcgccaattgctggaacacgacgagcccagattcaagccgccgaagcccgcgtcttaaatactggtctgccgcggcttaacaatcatttaaggccacatcacagagccttgcccggcatcatcaatcaacagcagacaaacacgaacagatgttttataataggaagcgactaaattcagaagggatgctccgatggcaactaagattggaattcgacaattggtagaattcgtcttgcgacaaggcgatttaaatgaagtaaagaatagccagaacactgcgttgaacggtgctaagattcatcgtcagctccagagtagtcgtggtgaagactatgatagcgaagtttacctgaaaaaaattgtgacgatgaacgatactgattacattatcgcgggtcgggcagacgggattcagttaaatgatgatggggcgttgattgaagaaatcaaaacatccgatcaagtcttcgaggacttaagtaccaacacgttgacactttactgggggcagatcaaagtctacggttacctgttactgcaagaacatcccgatcttgagcgggtcacgttgcagctgacctactttcaagtcatcaatgaaaaaatcacgaagacccagcaaatccttcaccgggctgaactagacgcattcttccacgacttaattacagaatatgaatactggttgacattacgagccgatttacgacgacaacgaaacgcttctattgaagacttgccatttccgtttccagcttttcgaccgggccaacatgaacttggctggcgctgtttataagacaattcggttgcaaaaacgcctctttgtcgaagcaccaactgggacggggaaaacgatctcaacgctatttccggccatcaaagcaatgggcgaagacgtgattgagcgcctcttttatctgaccgctaagcaaagtacgcgccacgttgctgaagaagcggtcacgctaatgagtcatgacggactcaaactgaaaagcattacgctaactgccaaggatcagattcggtttcccgaggaacaagatgtacttccggaagataatccttatatgattggctactacgaccgacttaaaccagcactcaaggatctgttgacccatgaagaccagattacccgttccgtgattgaacagtatgctcgcaagcatactgtcgatccgtttgaattttcactcgacacgtcgctcttctgtgatgtgattatttgtgactacaactatctttttgacccattagtctatttacaacggttctttagcgaacgtgatgacgacaactttttccttgtcgatgaagtccacaaccttgttagtcgctcccgtgatatgtactctgcggccgttagtgaccagccaatcagtgcgttgctaaaattagccaagcccgataaaagtcagccgagtgacgacttacaacgcgaactcaagaaagtccggcgtagttttacgcgcatcagtaaaaccttgattgatgaccaagtaacggaacaggtgctacctgatccccggacaaattattacgcaccctcagaacatttaatgaatttgtgactgactggttggcgcaacaaaagccggggccactgctcgacgccgtccgtgactatttcttcgcctgtctgacctttgttaaaattggcgacctatatgatggcagctaccagacgcgcttcgtccttgacggtcatcacttaacgatcaaggaactctgcctagatcccagtgactttcttaatcggtcattagagctcggcagtggtgctgtcctattttctgcgacgctgaccccgatggcttactaccagcgggtgcttggcggtgaagccaacagtttggcctaccagcttccatcaccatttccaccaaagcatcaggccattctcgtcacccagtacgtccagacaacgtatcacgaacgcgaacataacgtgccccggattattgccagcttgcacgccatgttgacagctaaacatggcaactacctcgtgttctttccgtcgtatggctatctgctgcagatcaaaactgcctttgaagccgcctaccctgatgtggcaactaccgcccaagcctcgacgatggatgcaactgcccggcagacctttttgaaccagtttcagtcagccccctcgcaaaccttactcggtttctgcgtactgggtggtatcttctccgaaggcattgacttacgtggcgaccgtttgattggagtcgctatcgtcagtgtcggtctgccgggtatcaaccacctgaaacgaacttgattcgtgactactacgaccatcaaaacggcttaggattcgcctacgcttaccaactgccaggcatgaacaacgtcttacaggctgctggccgcctgatccgcagtgccaaggacaccggaatcgttctcttgttagaccaacgcttcgctagtcggcgctacacagatttatttccagcacattggcagtactatcagacgatccaatcagtcccgcagctcgaagcaacgattgccaacttttggcaccaaatggaggtgactcattaatgaagactaaattaactaaacaacttgaaagtactctctatcagtactgtctagaacagggcgcctacgtggttgaagaagttgcgatgcccgctgataaagggatcgttgatacattaagctatcaacaactccccgatggtcagattgaatggcgttgctacgaattgaaagtcaccaaagcagattttcattcaaaggccaaactttcgaatttatcggtcattacaattactttgtcttgccgcaacaactttacctagaagttcaatcggaaattccagaccatattggtgtattgatctaccgtgcttttgatcagcgggccctagagctcgcaccccaaccgttgcgaacgcctggtttcctaactgtcgctaagaaagcccaacgccaagacttacaagtcgagcaaacgccccttatcagtcactttatcacatcgctctttcgtgaggtcgataaagccaagcgtgtgaagaaaggactacagctctactctgatgatcaactcttcaaagaattacgcaaacgggcccgcaccggctacgacgtttatgatcctgaacaaaacttgtacgatcgcttcatcgatgacacccagaatgacgcggtgactgcgctacaaacagaattagatgcccgcaatgccgaatatcagacactcaaactaaaatatcaggcgctaacggcaccagatctgcgtgaccaggttatgagcacttactacccctatctacgtggacggatgtatgatttgttagccttaagaacattgtgcgagcaacaccaacttggcccacacatcatcccagtaattgaaccagtccgtgactccaaagaattacaacaaacagtcacgacttttattgaagcccaacaaccatttagcattattgcgaatccccaagtgagtgtctatggtcttaataccgttaagatccatccacttccggatctgcgtccctacccattttaccggccgggcgcaattcttgcggctgattttagtcgcgactttctgacaaccactcctggtcaaacaagcttgctcatcgcggctaactatccgttgcttaaggcctatcagcatacgaccactttacagcatgctggtcatgtcctaatccctgatgaagcgcgtttgcaccaactattaccacaacacgcggtcttattgactgatcccgtggcaaccccagcgcacgttgcccggactatcaagaaataactgacgcctattttgcccccgctaactggcaccaaacaccggttggctttgatggttttggcgattactcactcatgggccgaccctattttgaccacggtatgccatcacgcgcaattgcattacatcttatttatgttacggttaacggtgacgcgcatccatcattttgtttcggacagcaatgccaatatgcgtggtcaaaagcaaaagttttttgaagcattaacaaagctcaccgactgggcacccgcacacctgacgggactcaatcgcacccccgcgcttgccaccctattggcctacgctgagggtgatagattcccagggttaggaataattaagaaattagcaatcatgcaccactttcaattgatgcaccgactactagcactgaattgaggagaaatgatggcaaaacaagaatctgcttggaaacaaatgatccatttctatcgtcatgattacgaagagcaacatgctccgatgttatacggcgacgtttggctgaagaccaaatcacatgaccggcttctactggggttaagtgaccaaggacaacacaatctgggtgtcgttcatcaactcgatttaccaactaagggccagcacctcgtggcgggtgatccgctcgtcacgattacggacgatcaaggggcgcatctggtgtcaacaccctttagtggcaccgttcagaagcttaacaaagacctacaagcggcaccccaatcgctcattaacaataaacaaaccgacaactggctggtccaattaaaggccgactaatttcgagttaccaaaagtaagttggctgacattcaaacaaacgcttacatttccactaaaagaactcgtaaattggcttaactaagcttagtcacgacatcagcggttgccagtcccagtgatatcacgcttcgaactttaatcacaacatttggttatgttaaccaacagacaccgtcttcatttgtaaacagccttgattgacccgctcagaaacaattgcgccgcgcgttatattacaaaagattacaaaacacgccgtttattacaagaattagggtaattcgtaaaaactccgctatttccctgtcacaatcgccagttatactaggtaccattgagtgcttggaagattcgcggggccaagccaaattcggactaaaaaataggagtgtacattacaaatgaagattaagaatgctttattatcaactgctgccgctactgctagtctctttgccattggtgctaccgctcaagctgctacggtaactgttaaagccggtgacacggtttctgccattgctgctgatcataacacgacgattgatgcaatccaacaagctaaccacttaaaagacgttaacttgatcttagttggtcaacaacttgaagtaaatggtgatagcactaccacgacttcaacacagacgactcaacaaacgaccacgacacaatcatcagctcgagactagtcaaactcaagctcaaccgagccaagctagccagacccaatcaagtcaaacacaaactagcaaaacgctgctcagacgactcaaacgtctagttcaacatcaaactatagcaacaatggttctgatagtgctgctaaggcttggattgctggtaaagaatctggtggttcatattctgctcgtaacggtcaatacatcggtaagtaccaattaagtgcttcatacttaaacggtgactactccgctgccaaccaagaacgtgttgctaacagttatgttgcttcacgttatggctcatggagcaacgccaagagtcactggcttgctaatggctggtactaaaaagccactctaaattaataaacaaatgcaaagattgcggatcatttctgattcgcaatcttttttctactattaaatccgtgctgaagcacgtgtgtcccccaccaacacccattataaagttactcagttgctaagtgactttataatgggccttagagcatgctgacaacccgttatttagatatgcgatatgcttattctggcaaccgctttaatacggacacgatccagacacgctagttgtcccccaatcgacgacccactctcccaaccaaaataccacatgtttttatttaacaattcaccaaccttaacggagaaaatccaactaatttcctgactaagtacagtcccgaacccccgacagtttgacgactagtccacaacgacaaccacataccattcagctatggcgtaatactaacccagtaacgttttagtagcgatcgtcatgggctacttttggcataaacctactatagtaatacttaattaatcgacgccttcgttaaccaaccacaattgactacacgatgcgcaacttctatcaattatctgctttatcgaaaaataattagtcagtgccacgtctccaagcaataaaatgactagttaagtgtcactataatcagacttcccgacaaatttaacccgtcaaaattcactagttaagtgcttaaaattatcgataatcctcgttgacttttcataaatcgaccaaaagtgatcacttttatcggataaagcggctaattttcatcattagtttccccgcttaatcattgtcgttattgattttctagctagttaatcgggattggtagcgctattttacatgaaatccggctcaaatattacaattcattacaaaaacggccttatattacaagcacccctaaaaacgtaatgttctgattattgcactgcaacactcactagttatactagtcactgttgattggttgagacatcaactgctcgaccaatagaaaatatatgtaaataatcgaacacacgcaaattataggagagtgtattaattattatgaagatcaaaaaccttgtattatcatcaactgctgcattagctttattcgctatctcaacaacggttgccaacgctgatacttatactgttaaggccgagcgatactgtttcagcaattgcccaagctcacaacacttcagtttcagccattgaaaaggcaaacaagttagctaatgttaacttaatcttcattggtgataagcttgaagtcaatggtactactacaacaaccacgacttctgctgctacaagtgctgcaccacaatcagcaactagccaagctacttcttcagctgcttcaactgcaacgagtgccagtgctactagtgcttcttcacaatcagttgctagccaagctactagttctgctgctacttcttcagctgctagccaagctacttcaagcgttgcaacgagtgctgcttcttcagcaagctcaacgcaatcagctgctagccaagcttcaagttctgctgcaaccactagtcaagcttcatcaagtgctactagctcagctgcatcatcaacagcttcaacaacctcaacgacttcaagctacactggtagtaacttaaagagctacgtattaagccaaatgccaatcacggactggcgtttcagcttcaacttggaacacgatcatcacgcgtgaatcaaactggaactcaacggtcaagaacagtacttctggtgcctatggtttattccaaaacatgcacatcagcagtggctctgttgaagaccaagttaacgctgccgttagcttatacaacgcacaaggcatggctgcttgggctttataaaataactgattactaacgaacagcgtaatgacattaattgtcgttacgctgtttttatgctcagattcatttaaaaggcgtatgcttagtagcgagaatacgaggaaggatctgaggagatgcgccacgaaaccaaattagtcatcacactatggggtggcatgttaggcagtatgttgttgattggcctgattttccagctaccacgcttaacccaactcccatcctcattaacaactggggtcgaagagctgttctttttagcaattgcactcatattaaatcgtgtgaactggctacggcaaaccttaaattttggggtatcggcaacttggcgtcggcaaatccggcccatcatgccaaccttaatcgtagccgcactaattggattatatacgttagcaaccgcccaacaactgacaaacaccctgaccctgttattcgttgccatattgatcagcctgttcgaagagacctttttcgcggaatgttgtttcaggccagccagtcaacattgggtgtaggtagagctgcagtcttcactagtatcctcttcagtttgacccatctaatcaatcttggtcaccaaacacttagtttaaccctattgcaattgggctttacgttcgtactggggctactattatgtttaatcacggcacagacaacatcgctactatggccattgttgattcacaccgtcaatgacttctttagcatgatggaacctccaatcaatttgcccggtataacgacgactagttttcaaatcatcgaaatcgcggtcattattctcctattaatactgccgattctacgccaaaatcaccagtggctgtcataatgaccaccggcaactaatcgatccgtaattaatataaccaacaccttcaatgtgacctatactaaagttagcattaacttctggaggggattccgatgtcatcaaccaaacgcggctggggagccgctattagtattttcattttagtaccaattctttttaaattaattgcctggctaccagtaccaactttatacagtgggctggtccaagacttgcttgtattacttatttttctgctattaaatcatttttggtttaaaatatcgattcagtggtggcaatcgcaatcactcgtacgacaatgcttgcagctcatccgggaattattattttattactaccaatgacgagcaacttcatcaagctatgtcatcttgcttggaccccaacgttaattctctatattggctacgccctagttatcgggatcactgaggaatatatctaatcggggcatgctcccgccactactacgacaatgcttccctcaccgactcatgctagccatttgtatcgacagtttactatttggtcttacccacctactcattaacagcagccagctgaccctcagctacgtcatcccacaagtcttttatgctgcagcgggtggcctgatttttgcggcctttatctacgaaccaataacttagtctggccgattttcttgcacgccttatcggacgtatccgtcgtcgttagtttggccacgcatacccacaccgcggccaagttgagtattccggttgcttacgcgattggcatctcggtgctctatctcgtcttgtttatcatcatcgcctttatcgttcgctggcaagttcgccctcaaaaacgattgttgtctcgttagcaattcacagtaatcaaaaaatgagtccccagaatcaaatcattctgagaactcatttttagtgacttatcttgacaaaaatgcgattgtcacaacgcgtcaactcacgtctgattcaatcgtaagagcaccctaggtttccgccacaaatttgtgcttttctaatcggtaggagtggtcacaaacgtccgcaacatccggttcatgcgtgacaataatgacgcacttcttttgttcatgcgcaattttttgaaattggtcaatcacatatttcgtattttcttcatccaaattaccggttggttcatccgcaaccactagtttagcatcgcacaccatggtccgtgcaatcgccacccgttgctgctgaccaccagataagcgttgaacattcttcttcatctgatcatctgtaatacctaaccgtcgtaacatcttcatcgcataatccttgtcaccacggtgttccgagttcgtaattgccatggcagtcatcagattattcaatggtgacatatacgtcaacaaattatatgattgaaaaacgattgccactttggacttccgatagttcgtcagaccaatcttattgattggttcaccattgagttcaatttgcccagcccgcggtttatctagacccgccagcagtgagaggaaggtcgtcttaccggaaccactttgaccaacaatggcatacgaagtccccgacttaaattcaaggtttacattctcaaatagactattttcttggcggtcataccagtaaccaagatcatttacttttaacattgccgcccctcctaatcaattaaaactttcttcggctgtagtcgtagtatgccaccagaagccagcataatcgacaggaacatgatggctaagccaaagccgccgagttcaactaaatccattaccgtgacattaatatctaagttcgtgtcggtcgtggcactggcattaccagtctgaccgccaccactaggcatattgccgcttggcttgctaccaccagtgttaccactaggggcgccgccaccgccaccaggctgaccccgctgactagttgaactcgtcgtagtcgttgcagtcgagtcgtttgttgtgaaactaactggtcacccagcttattaccaacaaacttaccaccgaatccggctaagacaactgagacgatcaagaccatcaccatttcagcaaagaattgagcgacaatcttccaacggctctcacctaatgataacaagacaccaatttcatagcggcgttcacgaatcatcaagataacgattaaagctaagataatcgttccagcaatcgcaacgagccagacaatcttatccgcaaatgatttaacgttattcatcgaactcttaaccgtttggtaactgctatcatccgttgacaacgaatacttcgacgtattgatcaactgtttaccagacgttttgacgctgctaactttagcggggtctgagattgcaaaagtcacagaatcagctgtgtccttgtacttagaacccttgaccgtgttagcgaacgtgtatgacgtgtaaacactgttgctgacatcggtactaccaggaccttgttgcggtgtacttgcactagatgacgctttatagatcccaacgatcttcatcgtgtaagtcttcttatcaccggtcgttgcttttaacttaatcgtatcaccgacgctcaggctatcttccttagccaattcactttcgatgacaacgttgttagtgccttcatcactagctgtaataccgcggcccttcgtaattttacttgagctactttcaaaggttgagacgctgttcgtattagtgaccccagtaatcgagatatcaccagtaccactgctacttgagccacccatacctttcatcccaccaccagtactactacctgatgttgaaatcgtatcaaagcccttcgcattagcggaagttgagacggtcgcattgtaacttgaaacgttgctaagcttggcgattttcttcgcatcactcagtttaacgggcgatgtcgtcaacttaggccgactacttttactcgtcgacgtggcgctgcgcatcttcttaaaagccgccttcccggttagcagataaagtgacggtcgccccgacacttttcttggcattactagttgccgtatcggcagcattcctaatcaataacccggccaatacaaacagcatgattgctgatgtaacaagtactaatagaattgaacggccttttttgccgttagattgagccatgcgcgtttaaaaaattcacgcttaaaccctccttcagataaagtattggtatgacaattgctttgcactgcttttaacctacacgggaaatctgactaatttgtgaacttgctgggtttatttatgggtctgaaaccgaagatttttcaatttgctagctaagcccctgaaaggctggttgtgcttgctactactagcattgcaccgtatcggaggcccgtttaaatgcgttagtcagcactttcgctgaacaccaaatagtcgcgacaagaattagcaattaattcttgtcgcgactattgaacttattgattaaacgaattacttacacaatcgtaaactcactcttccggtacggtacttaagtgccacgtgatcgtaccctgataacttccaggaacagcggcgggcgttgttttgagcaccaaaccttgttgcgatgaccagtgggcggtcacgtcatagtcgatccctggggccgtcttttggcgcgcgatttccacggcatcctttcccaacattgtcagcttggcaccatcctgataatacaagtttcccgctagtgtgcggccctgattagtcacgagaggggtcgcggtcgcctctaagcgccaagcggctttcgagcccgtatcatcattgacaactacttcaagtccctcgggccgactgacttgagccgttcccgtcagcttgattggtgcaaacacactttcagtactgactttttcagctgtaactccccaccaatgaccgtgaccgttactgtcactggttctgagtaggcgttatctttgctatgagcccgtaacgtaatctgattttcacgcgatttgtagttcttcggcatccacttcaaattcgacataaccaaccggatcgtccatgctcaactgatagtcttctcccgcttcaccattgacccggtactcgatacgcatgccatcattgtcaaagtctaacccatcatttagcttaatttggcccttaatgatgacgggctcgcctttcttcacttgtgtcaacggttcaatcgtcaggttaacggtcttattggtcgtaatggtgaagtgcggtgtggccgttgcggtcttcatctcgtgaccctcaaagtaactcatgtcatcatcaacaaaagtatcccgatcgaccttggcagcctcaccaatcagcgtaatataagcgtgcggatttttcattgatagtgtccgctgcaaatcgtgttgtaagcgggccaccgacgattcgttatcgtccgctggtaaattgatctcttcctcggtaccatccgcatagcggatcttcgcgtgactaaagtgaacttgttcaaggtaatggtaggctggccttaacctgttgccattcattgtcaccattgagataactcagaacgtactcatattccaactcatccccaccatgaacccagtctccttcatggacagttcgctcttgagtcagattggttacgtttaaatctgactcgatttcaatcggttgtggcaaccggtcaaagacgactagtgttctggcattagcggttgtcgccgtactagttaatccccaagtaacattccggatatcctttccaaaaactgtcgtatcaattgtggtcattcgtgttggtccctgatccagagtatagctcatgatttgtttactggcgacccacttcaatacaagatggtgccagttaccgtccgcgagtggtaatttatcagcgatactcccatggttctgttcaaaacgataagaggacgttaaaccaccccgttgcgtataagtatccggacttgcggggtagctcgcggccatatgcatttttttagggcttttcatcgaaagaattccccggggatacaaccccaaaaaccaccgtcattcactttggtatccagctccaacgcccaacttttttgaatcgccgtcttagcaatcgtggccggcgccgttcgccgtgtataggtatccgtcccataaacacccaagttctcaccaataatgcttttctttccataccgactaatcgcactcattttgcggggatcattctgtaaaacaacggccaatccttcacccacggctttgtccccaaagttcacccacattgagacttggttatcgacccgcatgttaaagcgattaacaggggtcgaccacattgccccaacttgattatcgtcatttgttaattcgataacatgctgcgaatggccattctttgaaacagtctgcattgtggccgaattacggtcaaactttcccggttcaaataagccttccagattcagtccagcgggtgccgtatcaagtacgtcagccttactataactaacggtatcactgcccctaaacagacaaacagtcctaacaagagtccccaaaaccttacttctttcacctaacgtcgctcccatcacttgccttccgcagctattcttacgccgtatcttagcaaattaagcgacatcatgtcaatgatttttatggttataataagtatttatttatacataaaatttaagcaatcgcacttataccaaaacatattgattttaataaaaaccagcgcctgacagttgtcatcgcgctggttttaaattgacggctcacttactcaccgcgccaggaattaagcgcgttaggccggtaaattttctggagcaaatgggcagtccaccacatgatcattaatgagaccagtcgcttgaagataagaataaatggttgtcggcccgacaaacttgaagccgcggcgtttcatctctttagacacttgttgcgccaagtcgtttgttgctggaacctcatcgattgacgcccacgcctctggcgtatgggctggttatcaacaaacgcccataaccaagtggcaaagtcttccccggccggccaatctcgaatcacacgagcattgttgatcgttgccattaacttctgacgatgccgaataattcgagcatcggttagtagtcgctcaacatcggcggtcgtcatagcggccacctggtcaacatcgtaatccgcaaaatcttcattaaaagccgcccgcttattcaggacggtctgccagctcagtctcgcttgataagtctccaagcacaacagttcaaaaagtcgttgctgattatgttgcggccgcccccattcgttgtcatgatacgcttgcattgctggtgatgaatccgcccatgcacatcgttgcattaaaaacatctccttatcgccactatccaatccggctatctcatactcgccgcatactcttagactaaaactaacactgtttttaaaatctaagtgcagcccctaaaaaagcgccgtccaaacttgaatcgttagacggcgccagttggttacacttattatcgcataactgacttattttattgacgatttcgtttcgtctgcttttcagcagtggtttcgtcttccatacgatccgtcaacggataagttaagcgaatcaaacttggaataatcgttgggatggcgaataccaggataatcaacccgataatcacaaccatcgccacttgaatcaacgtcaagacaccggatggcatcaaggcggcgaacgtcccactcaagatcaaggcagcggataagaccacggccccaatgacggcggaagctctgacaattcgagtacttggtgtcgcagccgaattatcaaattcacgatacttcatcatcaagaagatactgtagtcgaccccaagcgcaatcaacatgatgaacccgaagaacggtgtgttccaagttaacatgctttgacccaagaaccagttgctcaagatccgtgtaatactcaaggacataatgttaaagccaataacaaagtccctaagatgtagaacggttgtaagacagaacgcgtgataaccatcaaggcaatcaggattccgactaacataattgcagcggtccgaacgaagtcactagaagcaattgcttgggtatcgttcgtttcagacgtttgaccaccaatcgcaatggtggcaccatctaacgcagttcccttcaagctattcgtcgcttgcttttgaattgccgttactttatccatcgctgacttcgaacttggattttcattcaagacgattgttaacttcgttgcgtggttgttaccagacatataagccttcaaagcagacttgtaagtcttacccttcaaagtgctctttggcacgtaatacgtcttcgcagccgcggaatcctttaagccagtcaagtaactgttagctgagccaacaccagtgttgattgtcttagttccgtcgctggcagtcttcaaaccatcttggagcgtctgcatctgacctatccctaagctttggatactggtgtacatttgttcattaccagaggccacttgcgaggcaccactgttaagcttacttacaccacttaccaaggttggtacttgcgagttcaaacttgcagtcccactagctaattgtgaagcaccactatttaacgttgaagagttggcagctaattggttagtcccagaatcaagcgcactgatggcactcgttagcgttggaatttgcgcgcttaaactgctcattccattattaaccgtgtttgccccagaagcaagcttagtcacaccacctgtgtaagtatccagttttgacgcaagtgtattggtaccacttagcaactgaccgagctttgaagtgagttggtcagagcccgctgacaattgttcagtcgcagtttcaagcgtctgcatttctgtaaccgccgtttgtaatcccttaattgctgtgattgaattattatttgctgaaatacttgccgttgccaagtcaccaaggcctacgacaagccactcaattgagaactcgctgtttgtaactggttgttgagatccgcaattgtcttgagttgcgcactcaaatcagacaatgcttccagcccggcttttgcacccgacgtggtcgtcgttgttgcctttgtcgccgaagtacttgcactagcgttcgaactgttttgcgcgttcacggccgaagttactgccgaactaatagcagccttctggtcatcagtcacacttgaacccgcagcagcaaccgctgcagaagcgaccgtatcagcattcacagttgccgttgaactggacgatgtaccggctgcattagcagcatcagttttagccgcactttccagcgcactttgaacagtcgtcatatcattagtcattttagtttgcgcagaattagcattcttagcactgtcttgtaacaatgcaattccagacttaactttgccagaactgttagccactgtctccatctttgtattgagtgtattgagtccatccaatcaatgtctgcaattgtgacgcattaacgtccgtgcttccagctttcacttttgcttccagttcagctagcttggttgaaagttgactcgaaccactttgcaattgtgctacgctagaggttaagcttgcagttccttgagaaatagttgttttattattatttaacgtatcaagtccatttgacaagctctgtgtgccgcttaacaactgattaactccactagccaacgttccagtcttactgttcaactggttcaaaccattattgactgtgtagacaccattagtataagtaactaatccactcgctaacgagctcgaaccacttgccaactgactagccccacttgaaagggttccagtcttaccatttaaagtattgagtcctgatgaaacttcatccgccccatccgccaacttcttggccgacttcgcgctatccgacatattggcactcttcaatttactattggcgctatctaacccactaccaaatcttagttagccctttgctagcagacttcattccactagtgacggtgcctaattggttgccaacgtataattgatcgatttgtgagccaccgggttgggtgacagacgccacggttttaacacccttaactttttgtaactgtttcgttaagctgtcgatgacttttagatctttttcattgtttaaggcatgatccgtcttaatatataacgttgacggttcagccgtccctttggagaagtgatcctgaacaacttggaagcccttcttcgctggaatcgtgtcgtttaattcagccaacgtatcatagttcaactcattgttatacgttaagataaatggcaatgaaacccctaaaacaacgaccagggcgatgattgggtaacgaactgatgacgctgcaatgccgtgccacatcttgctcgtactaccgccagcaaacttcttcgttggccagaataaccgtggtcctaataacgccatgaaaaatggattcaaccgttaacaagacgagcaacaggatagcaaccgcaatggcaaccccaaccgctgacttgtaaattgagaagttcgctaacccaagggcactaaacccaattaatagtgacgatccactgtataggatcgttcgtccggcaatctttaacgcgcgcccagtcgcggcgaccggactatcgccatgactgagttcttctttgaattgatcgaacagtagaatattgtagtcggtcccaatcccaaacaagaccacgaccataaagacttgggtaaagttcgacaatggaaagttaaatttattaacgaggttcatcacaacgctcagcgagataatgaacgacaccccaactgacaacagtgaaactaacggcgtaatcggcgaacggaagactaacgttaacacgatgaaaatgaaaataacggtaataatttcagtcttctgaatccccgcttccgtttcctgagtgaagtcatcatttaagatgtcactccccgtcacgtacgtcttaaccccagccgttttagcaccggccgtaatattcttggtcatgttcgcgacggtctggttcttaccaaccattaattgtagtaattgggtggatttgtcttttgaaatcaattgctttttggcagcagcattatcactggcagccgtcattgatttcacgtgatattttgatttttgcactttgaagcgttgaatcgtcccatcgattgcttgcttctggtcactcgttaacggtgaatcaccattattgaagaccaccaccacttggcgcgtattattttgattacgcccccaatgattctgaatgacttgtgcgacttgactcttagcactacttggcaacttggtctggcccttatcacgtaccagactgctgatatttggcgggaagatgatggccgctaccatcacaactagccaaacaatcgcttggattgtaaaacgtctacggctccctttcacgttatatcccttccctaattcagattctttaaaacgacatcgtgacatttaatcaacaatgtgtttaaataataacaacatgttaaatgaaaaccggtgtaatttcaaccaacaattttcataaaatcgtcattaaataaacaaacaatagtatattgttcaaataatgaggtgaacttcagtggtaggtactaaaaacaaccgtcgttcgcaaatgaccgaacgcctaattcaagatagtctaatcaacttactccaacatcagtcgctagatgagattacggtcactgctgtctgcaaggccgcagatatcaaccggggcaccttttacgcccattatgaagacgtcaaagattgcatgcagaagatggaacaagatgccacggaagaactgctagctgttattgataaacatcttaatcccgactctttacaagccattctgacgggaatttttgaggtggttaagaaacgccacgccgttacttccttcatcttaacaaccgaccaggattttctgatgagctctttatcgcaacaactaagcgtgagatcttagcacataaccaagctgagatcactggtattggcaatcgcgaaaaagagtacatgtttgagtattatctaaatggtatcgttggtgttgtccgttattggttaaaaacaggactacatgaatcaccggaagaactggccagttttatcaacgactggtggtaccgaggaaaaccagtcaaaaatttggctgaacactgaatttaaccccactattcgattgttagtttaattaatctagctattcccattaaattaattattatcaatatgccttggaaattatcttgcatattaaaagtaacatgaaccctttaattgcaaaagcaatctaacttcttaattactttcttctatataggataccagtcatgtgcatggatggacttgattcgcgtcaagaaaaccccaaaatgcccgattattagcaattacctactaataatcgggcattttttagacttcttttggggagcgcgtcttaggttcatacatccgttgcttgatatcgtccatttcctgatccagctccgtaattaactgcgccttcttagtcaatgacgctcgcaatgcgtcctgatgcggaacgttcttcttataatttaattcatgctccaacgacgcccaaaagttcatggcaatcgtccgtacttgtagttcgacctcaatgatgctcggcccatcaacagtgtagaccggcaccccgaggattaaatgcaaactctgatagccattagctttaggatgatgaatataatccttcactcgtaatactttaatgtcagcctgagtcgccaataaattctcgactgtcttgacatcgcttagaaacgaacaatcaaccggatacccgcaatatcatgcaaattattaaacaccgcatttaacgttaacggtaaatgcttacgttgcatcttaccaacaatgctctcaggcgacttgatccgggactgcttgctatcaattaacgcgtagccgtaacgaagctcatactctcgactaatataatctaacttatctaaaacgagcttcatcgcaacttcataacgtaacgaataagctttcaactgatcaacagcttgcaaaagttccggggtgctggcaaaagctgatcattatctgcacttgcttgggaatttgttgtgctcaatcaatatcgctccaatataagactctattctctctcaatctaccttaacggatcgtgatggtccactcacgcgcaatttggtcatacgcaatttggtgcgcatcttcaccaacttggtaagctaagtgtccgtcaacatctgcaaaatcactaggaatcaggccgcggccctctaacacgttcaggtgaccaacgaccatgcgatcggccaagaaattctcaaatcgctgccagaagctttgaaaactggcgaaatcatgcacatcaaaaatctcgttgcggagtacttcggcatcaaattcaattcggattcgtgcactctttaaggtatcacttggggcctccttcgcatcggttaatccacactgcacattcttagtgactcattaaccaacaactcatttttgggactatctcaataataagacacgatgaccaagttacgcaatatctgaccaacaactgctatcaaaacttaagcgctttgtaatcgttgggttaattgattttacgtttcgggttcaaaatattcatcgggtcaaagagtgctttgatctgatgttgcaacatatcaacatcttcgcctaattcggcattgttccattgatttttcaacattccgactgcgtgttcacccgaaatcgtcccaccaagtgccagcgtcttcttaaacatttcttgtagcgcaataatgatttttcaggcacttcggttaccgacgttggccacactaaggtcgggtgcacattaccatcgccagcatgtccagccgtatagatttcgacgtctaaccgcttggatagttcttgaatatagtccaatttaatggggctaattgcgataatggcacggccatatcttccataatatgattctgaccagcaaaaactgccggcagcatatcgcgccgtaattgttctagcgctgcctgttccttaggctcggtcgtaatcttaacatcgttggcttgctgttcggccagtatcttcttaacgactgccatgctatcctgaccaccattatcaagcttaaaaatcaacatcgccgcactattcttagcatagtgcgtcttctcgtatcgatcgagtgccgcaaccgtattgccatccaatgcctctagcatcgttggataaacaccggagattcgaatcgccgtgactgctttagccaaggccgtcatattatcgaaaaaggcgacgcccatcacgggggtccctagcggaatcggcaacagtttaacgattacttcggtaatgattcctaacgtgccttccgagccaatcatcaattgcgttaaatcataaccaaaggcacgctttagcagtccgaccgcctaacttaacttcgcgaccatcggctaaaacgaccttaacgcctaagacattgtccttagtagccccatacttgaccgtactcatcccgccagcgtttgtcgccacattaccgccaatcccagagatgggcttagaaccagggtccggcgcgtagaacataccccgcttgcgtgcttctttatccagatcaccgttaacgacgccgggttcaaccacggcgatggaatcagccttgctaatttcgatgattcggttcatcttggcggttgaaagaatcagactgtccgttaacccgtccgcaccgataacagtgctcgttgtttggtcttggggaatcactgcgatgtggtatttacgggccgttttcaacgttccttgaatgtccttggtcgtatgtgcttcaacataggctaaggcaaggccactatcgtcatcggtcaaccgcggactgaaagagtatttttcagcgtctcctcgtcagtgaagacccgcccgtcagtgacttgcgttgctaaataatctaaaacttcttggttagaaaatgcgcgaaagactgtcaaattaccaaacctcacttcatatatttaagttcactgtcagtataagccaagaatccgttttctgccgtaatactgtccgtaagtgaccgctcctaatttgctcagtttccaatctaattcttttaggtggtatctattttttaaattaagtacactcaaaataagtattttccgggatcgtactgaccgggtatgctagaaacagtgatttcaagacaaagacgttatccgggaaccatcttaacgcctttaattaagggaggatttgaacatgcggcattcagcatcttcaaaattacggccagtgttaattgcggtcggcatcattatcgttatcgcattcgtagcgattggcttaattattcgccaggcacaggcgcgctaccaatcgacgatctatacgggaaacagcagtactaaaactcgatacgactaagccactcagcatcttactactaggtgttgacaccggggcagacggtcgtattgataagggaaattctgacaccattatggtcgttacgatcaatccgcagaccaagaaaacgctcattaccagcattccacgcgattcattagcagaaatggtcggtgatcaggacacaaatgttcaaaaactcaacgccgcttacaatattggtggctccaagatggccaaggctagtgttagcaagctattcaacgtgcctatcgattactatgcaactatcaatatgggcggtctcaaacaaatcgtggatgccgttggaggtgtgacgatcactagtccactcaacgtttcattcgaccatatcacagtaaccaagggcaaacaccatctcaatggtagcgaggcgctatcttatacacggatgcgttatcaggaccccggggcgactacggccgtcaattacggcaacaacaagtcatgcgggcggtttctcgccaaactcgccgagactaagacctatagtcgctacaatcaattactcacttcactgaagggtaatttacaaactgaccttagctttaacgaccttgttgggttagcgacgcatgatcgtgccaatatgaaacacatccagtcgactcaagtcattggctcacccgcttggatcaatacgagttcctatcagattttaagtacaaagaccttgcaacaaacgtcggaccgccttcggacccaactggggctcagtactgagacccttaccaacatggaaaccaagctaaatgccaagaataccgtgtatgacggcaaaaccaatctcaattatgacgcccaaggtttagataaaatcacttacagtgataataccaagtgatcttttaatgataatcaggcgtgccactgaagcattatagccttcagtggcgcgcctgatttagtcctagcctagttaaaattgattgctgccattagtattattggttgttgatttgcctaaagtatcacagttactgcttgtctgtcaccgtcttagtgcacccagccagcaagttgcgtcaccagtccccggtatcgtcgttaaactcatatttgatattccccggtcagcaacggcctggtgcttgttcacctgtaaatcactcacccgaaccgttaattctaaaggcttaaagttttgaactgagcgaatccagacatagtcggccagtcgttgtacttgcacgaaaaaataccgttccgttgtcgttgttaaatcaatctgttttaaaattcccgtttccattcgtgctgcacccctcattattttcaccacttaatatacgtgctgaaacgcgttccaggtcaaggcgcaacactcaattatttttaattgcaagtttgaatattacattttaataacagtaagcgaaaaagctagtcaatttagtcaaacggttgtactatgattgatgataaggttatttaagtcaacgataactcgttaaaaccatccaaaggagcaatctcatcatgagccagcccaacacccgcatccgcaagcgtattgctactacatcgaactgactggttccgaacggcctgatttactcaccgcactaactactagtgaacaagaattgggcgattgggaaccggttcaagcagctaagttaccaacttggcgtttatggactgacgctaatgccgacacgattcgctacaccgttgcacacgtcattgcccgtagcgctttgccgcaaaacgcttattggctattgcagtacaagggtactgaccatggtcaccccgaatgttgcacccacaatttcatacccgttaataaaaggcgaacccggtgacaattccaagtcactcggttcgctttaatctgcacgcgcttctcaaaaatcgacattaaaataccaccatcaacagactttcagcaagtcgctaatggtggtatttatacaattactacattaatgatttaacttaagcttcgaccgtttcgccagcagcttctttagcagcaaaggtcttttcttccttaaccttatcacgatctaaggccttgaagaagaagtagtagatggcaccatcaagcacaatattaacaatttgtaataccgcacctgagatgtgcatcgttgctaagtaaccagagataattggcggcgtcgtccaaggaaccatgaccccaaccgtctttgcaactaagcccgtcgacattgcaatgtaagtcgtcgtaacattaactaacggtgccaagataaacggaacggcaatccgatagttcataacgattggcaacccgaagacaattggttcattgatattgaacaatgcgggtccgataaccagcttacctaatgtcttgaattcggcactcttggcaacaaaggcaatcatgaaagccagtcccaaggtcgcaccggaaccacccatgtggacaaagttgtcgaagaattgttgtgtcacaacgtttggtaaagccttaccagccttaagcgcgccttccgcattttgagacatcgcagctaaccagattggttgcatgaccccagaaaccacgttggcaccgtgaatcccgaaaatccaaagaatacatacaacgaattcagcaaccaaggcccctggtaacgtgttactcaacaagcctaatggtttagctaagacgaatgaaatcacgttaggaatactctgcattggtgatgcttcaacagccaaccgcagtaaccacatcaagaataagatgacgaaaccgggtactaaggctgcaaacgagttgctaactgccggtggcacgctatcaggcatcttaatcgtccaattgcgatgcaccatgaaaacgtaaaaatcagtaataaacaacccaatcagtagcgccgtgaataaccccgccgaatcaagttgggttaatggtacccacagtgctcctgccttatcggtgtttaatggaatcgttaagaaccaagcgcctaacgaaacaattgaggcggagattggatcgatctttataactctttataactctttgccaagttataagaaatcccaataaccgcaatcaagcccatgatatggaacgaggcgttagttggatattggacgatcgttgcccaattcgaaccaaaggtattggccataaaggtctgataacccttgatagggaattgcgcaatgatcatgaagaccgacccgataataatcattggcactgccaatgtcatcccatcacgtaaggcaattaagtgacgagaaccagcaatcttgccaaagaaagggacaagtcggtcattaacaaagctcgacttgttattgttttcgctcatgtcgtgacccctaaaataatttgttgtgcatattcatttaacgaacattctcaaacaatcagaataatttaagtaagctaacggtcaatcaatagttaaccgtttacataaaattgagttcgtccgttacaaagtagtcctgtcatctgacatttgtacccatgaatacgcttcctacaaaattcattatttacctgtcattctcaaaatgtataccctttcactctaaaatgggtgttgttccatccatcggaatttgttctatttttagaacatgttccaaagattggtttgaattacctttacgttaatggctgaataatcatagctaattgttccagataataaacgacgggcaactgggacaaggtgctaccaccactgattgcttgaacttccggggtatcgtaagttaacaccacgtccgcaatcccagctaacgtcgaatgactgctagcggtaatagcgaccaccttcgcgccactctgccgataataaacgctttgttcaataatatcttcagactctccagatactgaaagtgcgaaaaagacggtatccgataaatcctgttgctgaaccggatggggctgactcgtatcactaatcatcaagctatataaaccaaagttagcgaataaatggctgccatacgcggccaggccagcactcgtccctgacccaatcagtacgaccattcgagcttgatgaaccagttctgcgacccgatgaagtttagccgtgatatcgggtaagttcatgcggtcaaaaacgtccgcatcggtacaactgtctgagctaacggttgtgtggcatcttgccgtaactgttcttttaatgtgaacttaaattctgcgtagccatcatagcccatgtgctttagaaaacgcaaaatagtcgttgctgagacgtgactatggtcggccaattgtcgaatcgtcatagtacttacttcagcgggatgacccacaatatacttataaatttcaatttccaagcggtttaactgctggacctgatcgtacgaaaacattgactcaccccgtcactattgattgattggtctatcattaaattaatatgaccattagaatttatgggaacaaattccgcttattgatcgccccaccgaccatcgatctgcggtttgatctcaagatcctgcatttccaaatcacaagttgctactactgcgtcagttaatttagccgtaaattcggccgttttatatggcgaatcaacggaccacgtcttaaagttgggcgttcgattaatacgtcctaacgccgcaatcgctggtacttccttcggatcaacggcgggagccgacttctttacattgatgttgtaaccataatgaccactgtgatacagtgcccgcatggcgtcacgaaaaagtcccatgtcactcacttaccttccattttcatagtccaattttagcataagtccggtgacgctttcatttagttcacacaaatccataaaaataagtcaaaatatcggaaaagcgtcataattattcgctataattagacataaaccagggttattgagaggagcataacattgaaaaaaacgattttaattgttgaggatgaaggtagcctatctggttacttgactaaagaactacaatttgaggatttcaacgttttggtagcggctgacggtttggcagctatggtaaacctaccaagcgcatcaaaacgagttgctcctcatcccgctagactggatgttgccaaaacttgatggtatggaagttcttcgccgcattcgcaaacacgatcaagtaccagtcattattatgaccgctagagattatgtcggtgataaagtcgccgggttagataatggtgccgacgactatatcaccaaaccatttgaaatcgaagaattattggcccgaatccgggttatccaacgacgcattgaaaatcaagttgaacccaatcaagtctaccaactggatgatgtccagctagatactaaagctcaccgcgttactaacgggcgggaagaagttaccttaactcaccgtgaatatgatttgctgcaattcttcctcgctcatcccgacgaagtctttacccgtgatgacttgcttgaccaagtctggggcgccgactttctcggtcagcaaaatgtcgttgacgtttatgtcggttatttacgtaataaaatcgatcacgacaaccggcgcctccccactcattcaaacggtgcgcggcgtcgggtataaactaagggagccgatgtctgatgcccaaaaataacaccactccgacctatgaacagctgatcaataaggccatccgccgactaatgctgacaattacgttgttggttagcttgatcacccttctgatggtcggcactcagcaaacgatcaatacgactagggaagcccgtgacttgatgagcagtcttaaccaggcgaatatcaaagacgtccccagttttattcaatggaacaatacgacgacacgcaatacgaaacaaccggcatttatccgggtaaccaccaagaaagcaaccttgacgaccgccactaaaacgaagcggacgatcatcactaccccatcgtccaaatcgtttttcaccaagcaacagactaagctagtagggccgttagtctacgttcgcggatttggtttcttcttatcttatagtgaaaaagatgggcatccaacacttaccaactatgggtcagcttaaggcgattgttcaacagtctgcttattttgattctgctcatgctggctgtcacttgtgccgccctggcattggggacttggtgggcccatcgtttagcactgcgactgagtgacccaaccattaaactgttacacgcaaccaagtacacatcgaacaatccggatagcgaccagcccaccttagacgtgctcgctagcccccgcgagatcaacgacctcggtcgggcctttaatgaactgttggtcacgcaaaatcaacgattgcagcatgagcgtcaatttatttctgatgcttcgcacgaactgcgaaccccgattgctgcgattcgcggtaatctcagtctaatcaagcggcggggtgacgcccaccccgaagtgattccagaatcattacagtttattgatgaagaatcactaagaatgcaacatctgattgagaacctacttcacctttcacgagctgatcgcgctaagctagtcttaactgaccaagacctatcactattaatgttgtcactggctgaacattaccagccatcaattgatcaaccattgacgctcgcaattgatccgaacatccacgttcaaggtaatgcggaaatgttacaacaaatcgttgtggccttactcgataatgcccataaatactcgccacatgatcaaccgattaccttgagtttgcaccagactgatcaagcagtcgaactagctgtagccgaccatggtgagggaattccagacgaccaaaaacaggctgtctttcagcgtttttaccgcgttgaccaatctcggtcacaagcaatcgaaggcagtggcctaggcttagcaatcgttcaacagttagtcacattgaatcaggccaacattaaaattaccgacaaccagccatccgggagtatctttacggtcagctggcaactatagtaacaagtactattattttattttctaataattactctcataaaaaaagccgagtcactagaaaaatctaggactcgcttttggtcttgtgccacccaatcacaaagatacctccaagactattctgaattgatattcagaaactaattactactaacccatctgcgtggttttatgagatttcatactcaaaatatcaccatccaaatgttctatttttgcttttaaatattgtttttctattttaatttgcgcctcttgtgcttctagatctccgtttaaacgtaacagaaatttttttagtgcaactgtacgttctagtgttacttcttcaggacggaaactgtattgctgaatctctttaattgacgcgcctaattgccggagatgtacaattcggttaaccatctcttgatcactagccgaaaattgtcggataccattttgatcacgcttaatcgggccaattagaccaacactttcatagtaacgtagtgcattattcgacacaccatatttctgagcggtcgccgtaattgtaaacatactcgtatcctcctaaattttgcttgcgttagtgtaacacgaacttgttatactttcaaatgttcaaaaaataggaggttgaatttttatcatgaaaacaacaactcgttcttggttagcaatgattgtcatcggtatttttacaattatggctaatctcgatgcatcaatcattaatatcgcgctacctatcatgtcaaaatcacttgcggttccaattagtcagatcacatataccgtgatgggttatatggtcattctatcaggcttactggtaacattcggtaaacttggtgatatttggggtaaaggtagaatctttactttaggtatgtatagctttactatcggctcactaatggccagtgtcaacttcggctttgattttctactattggctcgttttgtgcaagcagttggcgctgccgcaacgctttcaaacagctatggtttaatttcggaactgtttgataatcacacccgggaactgccatgggtatcaatcacaatgtttatttccgctggttttgttgccggacccgccttaggtggctttttactacagcagtttgcttggaatgctatttttatgattaacattccacttggaatcattgccattattttaggccacctatttcttcccaaaaatcatggccggcaacaagccactaaacttgatggttggggcgtggggattctattcattatcatcacactattctttgttgtattagaagcggggcagactattggtttcaggcagccgctaattatcattggcttcattatcacattagcacttacactatactttatttatttggaaaagcatcgaaaaaaatgcgctattaccactatccatttttaagaatcgtaccttcagcttagcattgctagtcggaatgctgataccacttattaatgcactgttcagctttatattcccactctatctccaagattatttgaactggtcagttggtactactggaatattaatgctgatttttccacttattatggctattgctgccccacttggtggctggttgagtgatcttttctctcaacagcttgttctactaaccggcctagtcctaattataattacgcaaattggcttcttattcctagattcacatacttcattaaccctcattatttctttgttaatttccaacggtatcggcactggatttttcattgcaccaaataacacattactaatatcagtcgtcccacaaaatcagctaggagtagcgggttctctacagtctttgggaaataatattggcaatattttaggcgtcgcacttggttctcttgcactatttacaacaatgagcatcgatgctggatatcgagttagtacttacttgccagcacatcccgcttggtttgcccatggtttaacctggtcctttagtgtttctcttatttgtgctttattaggctttgccattagtattattaaccgccccgcacactaagctgtaattcatttacaaataaactcttaacaaccgttttaaggacattaacagtcttgaaacggttgttaatttaactagtacttgatcccgccaaagtattactgctcagattcaattttcatggtatttttatattctaagtctgaatctaagaatttcttagataaagtttatggaaagtcgatagttcccacggcgatatgccggtaaactatagtcattcaattaaacaaaccaactttaaaaattaactcataaaaatagaatgactcacaacaactaaggagctatgtagatatgttattagatactgatccaaaaattaaaaatatcaccgccgttcaattggttaaggtgacctacccactggtgattgcgaaaactgaagagggcgaattcgttaaagtcaaacttagtgatgaacaactacaagatccattattctgggacacgttaaaaaacatccgccgttcgcaattatgggtcccacttggtcgtcagcttccatcaactactctctaacgactggttaatgccagctgcccaataatcattcactaataataacaactaaaaggagttcgattattatgaaaaacacattcaaaaaactaacccttactctaatggctgccggaaccctctttgcgacttccgtttccgcctctgctgacacgacgacaacaaatcctgaagtgacatccaccacactcgtcaacaaagttactcgtgatactaaactcgcaacgggtaccacgacccaccagccgaaacatgatttaacaccacagccaactaagcttgtcgttaaatccacccaaaatcaagtgttagcaaccattgacgctagtagccagagtatcactaagatgaagtatctcactaacgcaaagtagtactgccacccttaatttccgccccgtcacttaaacccttaaaggaggccccgcgatgagtcagctgactaaggccattacccgccaattacaacgtcaatatgcccgaaccagttctgaaagatctaaatggcaactggtataccggggccgatgttttagaagacctcgcactgtgtgaaactagtctgcaacaacagaacgtgcatgccggacaagccattctactgagccccgcacaagtcgtaacgattccgggattgttgctcgccagctggcaattgggactgacggtcaccctgacaccgcctagccgccaattacccgagctggcgcctcaaatctacgccgccatggtttattcccctagtcaaacgaaccagttagcaaccaaattagatccccatgaaatcagcgttttaacgctaattctcaatacggcgcctaatttttcttacctggttcacgaccacgcccaaccgttgacacgccgcagccaaccggacctgattctaccagccagtcaactccagttcacccagcctcaactacttaagatggctgagcacggtcaaactagcgcacacgttcacgatttatatataaccttgagaccggattgctccccgcctcacggacctcatcactgcgaccccgtttaccatcataccaactaagcaagactggccatccaaagtcggttaatcgccaattactggtacgtattagcacttggcgctttgaatcggtatcttgcattgcagctgttcccaaaacacaaaatgagctttccaggaattctttgcaatccctggaaagctcattttaatgtttgattatttaaccagaccgatagtctgtaaaataaggtaaatgtttaagatgattagaatcaccgtcacgatccaagccgtccacttaacccagacacggttggtgaagttccccatcagcgcccgattactcgtgaacatgactagcggaatcatggcaaatggtaacgcgatactcaggaagacttgcgacatcgtcagcagatcttcaattttcgcttcattgccatgataataaatcgcaaaagccaacactggtgtaaccgagagattaaccgagttagtaaccgttgtgcccagagtggcatcttcaaacggataaacccttccatgataatctgaccagataacgtccccgtaatcgtagaactttgaccagaagacaacagcgcaatggcaaagagcatactgagtaacggactcgcaatcgagccaacgaccttactatcgccaagtgcattgtacaagtcaacgaaccggccaagatccccttagttccaaagaacagtgcggcgccaagaattaatagcaaactattaacaacgaacgcgactgacaattgaatattggagtcgattgtcgtgaacttaacagccttggcaacttcttttcgtcactccggtcaacttgacgtgtttgtgagattgatgatcccaagtacaagttatgcggcataacggttgccccaacaattccgagtgctagaaatagcatagaacggttgctgacaatccgactagttgggacatacccttttaacatttctggaatattaggttgtgaaataataacttcatacaggaagacgaagagaatcacggcaaccagcgttgccacaattgcttcgattttccggaaaccaagtttcattaataataacagaatcaagacatcggcagtggtaatcaaaataccgacaattaatggaaatccgaataataacttcaaagcaatcccagaaccaatgatttcagcaacatcggtcgccataatcgctagttcagtaataatccagagaaaaatccccattccttttgacgttcgttcccgcgtcaattgtgctaaatctttacccgtcacaattcccagacgagcggccatggcttgtagcaacatggcaattaaacttgataacaggatcacagaaagtaatgcatatttgtactgtgatcccacgcgattgatgtgatccagttcccaggatccatgtacccaactgcaactagtgcacccggtccagtgtaggcaattaaagttcgccagaagctgggcatccttagggacccggacactcccattgacttcgtccaagctcttactatcggcacccgttgaatgaatcgccttttcttcggcagctttcatcttagcgtgatccttcgtttttgctgatttcattatgaaaccctctcttctattggtttagaattcaggttgtggactactacgtgatcctcaacagtgcgtccccttaattgagcactcactttaattccaattggtagtatagcaccattaacctattagtcaactattattaattattactttggcatccctaaagcttgttatgacgcggtattatcatcttgtaaggggattctccgtgggctcaaaccattaactaaaaaatcactgagatagtgaatcaattgctcatcactcaaatcatccagttgtgggtagagaacctgttcgactaaatatcccccaatggttgaaaacaccaattgtaaaatcatgcgattcggccaatcaactaattctccgagcggctttcaagcgatccatcgcttcattcgctcgcgccaaaatgctaggtgagaccatccctaagacagccgctcgatcctgagcattattgaaaaattgggacaaaatgacggctaaggaggctcggttacgtgtgacaaatgcgacccgatcgcgcacaagggcgacaacaaatgcttgcaaagtctggttaggactatctaaaactgcctggtccaaagtgttcaacatcgttggcaaaatattctgcacaatcggctgcataatggcgtccagaataccgttcttattaacaaaattatgaaataaagttccttcagcgacaccggcccgctctgcaatctcccgagtgccaacttcttcataacctttttctgcaaataagtcgagcgcggcggctaaaatttgccgttgggtccgggtaatacgaccattcttccccaatgaagccgcataataggcctggatggtttcaatttcactcatgatgataagtctcctttttgcagtaactgctcaattttggcatttacatcataactgattcggtcccccaaaacaaccatctttataaaagttacatcattagctttactaaactcgttaattgcttttataagtggatttatttataatcatagtaaccaattaagttacaggaagtgattatatgcgtgtttcaacccgctttagcgactcgatccatttactagcctacattaaaatttacgcagatactaaattaacaagtgacgccattgcccgtagcattgaaactagtccagtcgttgttcgccgattgatgagcaagcttcgacaagccggactaatcacaacaacgcctggtactgctcaaccggcactcgccaaacctttaagtcaaatttcactgctcagcgtcttctacgcaattgaaggcgataagccactactcgccgtcgatcctaagaccaatccggattgtattgttggtggcaatattcaaaccgttctgaaaacaatactatcaagacgcgcaaacggcggccgaagcacggttagctaagactagcttacaagacgtggtcgataacattttagtggaacaagcaaagaaagatgcccacaaataagctgccagattagctgacggtgtgcgattgcggaagccagcgcgcatgtcgatactaaataattcaccccgcaagccactccgtttaaatacaaacatgctagtatgtttatgcctaacttggacaaaaaattgcacttcagaatcaacatctgaagcgcaatttttttgttgaattatttcatctagtacaactttaataacaataaacggccagctcggtgcatattatccagcaatagggcgcaaagacaatattgcgctgttttcgacaccccatgcgtcacgaatctaccgcggttgctcatcttgtccataatattccggcttttcagcctggacgggatgggcctgtaaccagctaataatctggcggctgaggtcatccgtcattggtgccgcagctgctatttgtgctttagtaatttggttgacatgaattcccgcagtaattgtacagcttccagctagataacgctgaatccgcttggccattcgttccgaaataaagttatctttatggaagcgaccatcatggctgggaaacttaaccgtttcgggaaccgtgctggcagttagtatggtcacgtcaccaatatggggattggtcccaccggtaacgacgatcaacaagtcatatccaatcacttggagtgttgcttgcatttgatacccggcccgctcagtcgtaaaagttgccatacttaatccccctcccaacggcgatcagtttcattatgaatatgaaacgcatctaaaattttcatggtttgatgattgaccagatcctgaatggattgcggatgattataaaacgcgggaatcggtggaataatttgggcaccgagttttgtcaacttcgttagattttctaaatgaatccacacgcttaacggtgtttcacgtggaacaatcacaagtttacgttgttctttaatcgtgacatcagcagcccgcgatattaaattatcaccgaagccgtacgcaatccccgctaccgtcttcatactagctgggacaatgaccattccgtcattcaaaaacgaaccgctggcaatcgctgcgccttggtcattagcccgataagtagcatccgcgagcgccgtcagctgcgcgagcgagtaatcagtctctaactccaagtttttttagcccacgcactcattaccaggtgaacttcaacatctggccgctgatgtaacttttctaataagtcgactgcgtaaatcgtaccggacgctcccgtgattcccacaacaattcgtttcatgacaacatcgccccgtttctacagattaataacatgtgatccaattaagtcttcatccttatattaacccgcactatcggttgaaacaaatcgagttttgactggctaatcaattcttaaatagaatattagccactaataaagagggctgattacgagtcagacgtaatacagcttgcctacttaacttgacgatgaattggctattcattccgcgacgaaccaattgtttcatcatattaactacaaagaatatatccatcagtttaaatgttaaaagccaactaatgggtgaactaaaatcaaacaaatacattattaatacataaatacactccaattatttactagttaagtcaatttttcgaaagaaaatcaagttttccttggaatcgttttaattgtattttggtttaaaacagttagttgctagataaaccagactaccaatgaacgtaatgcccgttagcaataacaatccaatgtgtttggactgacgagctatagagacatcaatataagagtccccggccggtaaagctgtttttaattgtccctcagaatatttaaagttcttctttttaccattgaccttaaccgaataatttttacatttttatagccaataacaggtaacttaactgatttcatattcttctgatgatatttaaaagttactagttgatcatttgcaaatgtgtttttgaacttttgagaattatcagcatcaaattgcacagtttttttggttgcacgtgatgctgtggcaaaattaagcgcagcactcactttcttcaaagactgaacagactcagcctttttaatatggtaatcaggcacttgtgtatcgactaatcgcttttggtagttagcattagttaaatattgatttcgacgttgttgtgcaagtgaattggacttcgattgtttcagtgcccagaaataattttgtttagtttgattatgagcagatattacgccactcatgccaactgtgattaaagcaaaactgataaaaagagtcgttgagtatgagtgccagttaatttggactaagaacaagatagaaccaatcatgagtaataacacgacaatggttagaaaaacgccattgtaaattgaaataaacttactggggtgttagctaaaaaatcaccatcaatccagttctgtgataacacccaaatacttgcggcaccaatgatccaatagcgccatgaacctgtttgatttgaaattagctgtgaaattaagtagaaaaataaaggtcactataatacctaaatgagcccctctagctaactctccaatgttattagttaacatgcgattcaaactcgttaaaggatccagactaataagcagtcgagcaggtgctaccatcttattgtgtaatagccagtcaacaatattatatagggaataacttgacataattatactgataaaagcgccgattagtaactgaagcaactcatgccaagatagatttcgacaaagtaacctaataatttcaagaaaactaattaagactgtaaatagcactaatgaaaggatgtgggaattggcaactagacccatacctattgcaaggactattgtgcctttgtttttttcgattccaaatctgaaacaatcccaacataatcaaaggtagaaatgtatagccgagcgcttccccaagtgccacacgagtatacattagctgaagatgataagcactaaattgatagatagagacacttaacaaaatgattaaccgattacgagtcaatgattttgctagccagtatgaattaaggattgtaaaaaaattcatcaaccagaaaccaatagctagtgcaagcatggggttatcaataatgagccgaggtattatatagattaacaaagttatccagggatacatcgcattcatcgcaaccccttgattgttaaagccgatgaagttgatgaggctcggagcccgtccggcattaaatgcttgatataatgattccaggcgggccagatgaacaccaccgtcattactgagttcaaagaaatgtccactaaaggctggataagtcgaaatgagagccaatagagaaataattattaatgttaagagaggttgcttcgaagtaacgactatttttcattttgagaaacatgcgtagcccttccttagctaatatgattaatatatccaaactagtgtaactaagtcgaaagttacattaatagtttctttgtaaagaatacacccggttaaattcaatagaatcagcgggctgaaatacttttattgggaacaagttaaactaagacgcaatattgatactatatcttgctgaatgttacttgtaattattttcaaaaaaagaggctcacgactgcctcaaaatgagaaggttcgagtctctttctatgcgctataacgtaaatcacactcataaaattaataaacaagtagaatctcaaagaattgccctagtttcaaattcatttaaagcattacggttataatcacgccaatcaaagcgttcaaaacaaacctgttgttccatatctagcacaaccattattgctacatcactttgtacatcataatgagcaagttgactgttctgaaggagcggcacgctttccatcaataaacaccgcgtaattcggatagctttcaacgtgtttaatttcaacgaatgcacgcccattgttatcatttcctaaaataatatctggatttttccagtcatctgagctagtaatccattgaccgtcaacttgagtttcagcatgaaagattttcaatggttcttttacagtttttacatacttgatactgtccttggtctcaattgagagagctaaagtattcgccaaactatttggatttgctacggcatttttaccgctcagcaagccaaaacgtccacccttgattacatcttgaataccagcaacatctgttccaacaaccggcttgtgtgcaagcaaagcttcaataatagcaagcccttgcccctctgtaactgatggcagtacaacataatcagtaaatgacacaaatttcattggattctgcaaaaatcccatcatgaacactgattcatctaatcctaaaccgggaaataagttgctctacttccagtcgtattggaccatccccgacaatatataatcgcgtcttcggataattatcatgtactaacttaaatgcttggattaatcctaaatgattcttttcaggagacagtcttgccaccgtcacaaaattaaaataattctgatctacaggatggaataattgagttgtaataattccgcttggtgtctctgttttagtaagctctatcagtgaatcaccattatccacttgttgctttacctcagataattctttttcaatttcggcgccattaactagattctcaacccatgtaaacttagcagaatcagcatactgactcagatcttctcgattttgtttatcagctgattgggaaactgaaatgattttgtcaaaatattgataataagtaaacgtaacacgcagattcttacgatgcttgtatcgcccattaacaattttattatattcatcccacatagtattgtgtagaaagacaaccttctttggaactggtgataaagcaaataatccagtaatagctttgttgtagccaccaaagtcaatagcttcgtatggcataaaattaccaaagatacgcctaaaattcagctgatacgttgccttcatcttattttggttaactaactttgaattaaatccgaagtggtagctagtgttctgattataagtatcaaagaatgttctagttgcccatgaaaaactaaaaataaagtgtacgctgccgggtaaacgactcatattatattctttttcagggcgcatccgcggataatcaacaaacactaattcatatttattagtgtcaaaattcctagacaaattaataatagaatttgtaatcccgttattatagaaacctccggcataaatcaataacttctttttattattgttgaaattaagttgctcaaccgatgacgactcttcaaacaatacttgcactgcacgttcagtcgcttgtccgtcatcataactccaagaattcggtttgataatcattgtactgttgttcgtaagtcttggcccacgaatcaaagtatttttgattacagtcattaagcaattgatcaaacttatccgtgaccagtcccggaagtgtatcaagcggcttgtaaaagcctcggttctgtgcgtagctgtccttatcaggaacataaaacataacgggccgtttaatcggcaaaaagtcgaaaaagatactggaataatccgtaatcaatacatccacaccacgtaacaatgtgttggtatcaatggcatttgaaatcaattgatcaccatatcccattttaactaatttatcataaataaaataatgtacttttaaaaatactttgtagccagatggaacacgttccgcaatcgttggacttcatttaacaactgtaaaatatcagcttcagtagtatattccacatctttttttccaagttggcgcatacaagattatcttttcagctggaagccccaagcgcttctttcaacgcttgcgtatcctctgaaactagtgtccctagtaagttatcaactcgtggattaccagtaatatagacttcatttggaaaaataccgtttaaatcatggctcgtaattaaatgctcagccgtaaacttgttaggcatagctaagacatcagccgccaataaattacgctgaatattcttatggtctgccctacctgaacctttaatatctaatcccagtgtttttaaaggtgtcccgtgccaagtattcagataccgttgcccatcccttttaataaaatagggcatgaaggaagtatcgttaattaaatactttgaggtagctaaggctttcatatactgacgtgattcgtacttaactaaatatacccgatgtctcttggtatccgccataatatccgaggaattgtatctttgtctttgtatgcccaatagtacgtataatccggatattcttgtaccatcttttgatacatcgcatacacatttccagtcaaattgacagcatgatacgattccaagaaaacagccttttcttgaactttgctatgtttcacatagtataaataaacattaatttgacgaattgccggcttagttacaaactcccgaattggccgtgcaacaaacttacacgcgagtttgatggtattcatctttcccataatatatatcattactccttgtacttgactacagtactctagccctaatggattagcctgtataattatttgcgttctgatctatgctagtaatcaacttcacaactcgttgactagccgttccttgctcccattccgtgaactgtgtccgaaatgccatcatcttggctttttcgtttggataaccatcattaatcaagaactgatctaacttggccagaaaatcccgctcattggtgacaattggaccaggaaccttgttgtaatcaaagtagaatccgcgaacatcaccctgataatgcgctaagtcataaggataaaatagcataggtcgattcaagatagcgtaatcaaacatgaccgaagaataatccgtaatcaataaatcactaattaagtacaaatcattaatatcttcatccacacataatttaacattgtcctcaaagccttggatattgatcgactcagctactaggtaatgtggccgaataataagcacatcttccttattaagccttttaacaatagcggccaaactaaaaggcaagttcattttatacatacctttgcggataaaaagtcatctcgccaagtcggcgcatataaaattactttgcccattttattgccaacaattctttttttaatcgctgcaatcgcatcataatcctggcgctgatgcactaaccgatcgttgcggggatacccataatccaagaactggttgttaaaatcaaacgctcgtcgaaaaacgtcttttgaaaactgattgggtgcaattaaataatcccaccgtttactctccgtcgtgaaattctgacgatactgacttgtatcggtaccaggcattgaaacttttggaatatcaatccccagacgtttgagcggcgtaccatgccaagtctgaatataggtcgttttcgcattcttcttcaaccaatacggcatccgcgcgttcaggacccagaattctgcaaccggtgccactaataaccatttggctgaaaagcgtggaataatattcaacttaggatacttttcctgggcttccgcaaccaactgacgcttaacaccccagactagcttccaatctggatgcgcggtctgaagtgcttcgtaaacgtatagcgggttatccattggaactttaccattaaacgcctcaaataaaataacgtgttttctcactgggcacacagtcgcaattacattgaacagtcggcgataaacctgactgataatatcttttaatgccattttattgaattccccgtcacacgtttatttttgattgaaattcaagtcttgcttaatcttagtcgttgagatttcaggagtccgtggtaaatagatgacttcagcgtcagtttgttcacccacgaaatcaaatttaccagtccagtcatcacccattacaaagcgatcaatttggtataatttcacgtcactcactttttgatcccacgacttttcagggatcactaagtcaacatagcgaattgcttctagtaatgccttgcgcttttcgtatgaaaaataggccttcttttgcttgctgtcccagttgaactcatccgttgatagggccacaattaggtaatcccctagtgatttggcacgcttaagtaattcaatatgcccataatgtaataaatcaaaagttccgtacgtaataactcgcttcatagtaaaactcctcctaaaattccttcgttaatttttattaagttcaatgtacacacctgaatgtaaacaaggctattatatcatgaaaagattgactacacccatcattatacaattcttaatgagccgcgctttttgtatattttatattttaaaacaagcgaaatgcatatatcgcgcaaagacttgcccggattgcggtaatcatcattgcaatttgtcatttattcacccgtgccttttatgttgcaatccgcataaattcccaagaagctaatccacaatgatttatcgttaaaaccagacattcaatgcgccacaccacgttttttggcctataattaaggtagtgtattaatgagggagggatgtctatggcaaaacgacgaatcacacacgacccacaccagtttgttaatactgctactgaccggcgacgcttacaattggctgtccaattagccttgccaacctgtgcgcacgtcttagcacgcaattttgcgcgttctagtgccagctcttactggctactaatgctaaagacgccggggacggctgccccgcgctttttgaccttgcggatcgcggatcatttgctatggctgacgaaccatgatcaattaaccattagttggtgaggctggtaattttgacgccgttcaacggaccttgcgtcaagaattaacaccagccactctgcaacaatacagttatcaactcacgacaactgatattatgacactgcgcttgattctgcatttggaacaacatcagctcatttggttggtccaattagcacctgaaatcgctaaggcctacaagaatcagcattttgaccttcgtgacgactttggtcaggccaaattgttactaggcaacatgaataacagtagtctccaactggtgccagttaagcaaccagctttccaaaatcatcttggacaatacttcggccgcaatctcctattctcacagttcaccagccaccatctattgcgactattgcccaccaatcaatggattcgacccttactaaaggtgttgccacccacaccaaatctggaacagcaactagcagtcctgtatggcaccgactttgtccgcatttatgttgaagcgattcgacaacaagcacgtccttgcaagcgattagttcataaaaataagacccccgctacgttcagcgggagccttattttagttactgactattagtcgcttttaagttttccttaggacctaacaacttatccgaaaaaccaaatacataaactaacatcgttgcaatcactagtgtcccgtaatgggatatcaaataaccataaaagtttgacccgatgccgacacccggggtgataaacgcggggaaaccgatcaacgaccctgacaaagcatagttattaacgcgcaacaggccggtcagtaagccacctagaccactcgcaatgctagcaacgacaaagacccgtttgtatttcaagttgaccccgtatagcgccggctcggtaacaccacaaaaggctgaaattgcagctgccagtgagatctcctttaggtgcttatccttagactttaagaagacggccaacaccgcaccaccctgagcgaccatggtaatcgagaggattgcattcaagaaataactgtgcccattcgtcgcaatatcattgatcacaatgggaataatgccccagtggagcccgaaaatgaccatcgtctggtataaaccaccaataaccaatcctgataaggccgggctaaaattatagacggcgaccaaaccgttggccaagcccttactgataatcgtaattaagggaccgaccaccactaataccactatcgccaaaatcagggcttcgataatcggaataaagacgctccgtaaatacagcggaacaactcgttttaacccccgctcaacgtacacgcctagccatgcggccacaatcatcgggaacacggatgccgaatacgacattaaatgcgtcggaacacctaagaacgtgatttgggccgtggctccctttactagctgccgttatcagacttggatagataagaatagcaccgacaatcgccagcacgattggatctgaacctaactttttggcagcagtaaagcctaggacaactggtgtaaaaagtaaaacgttgcatcagctaccgcgttcaataccatgtacgtcccactcgtgaccgccaagactttgaagcccgttaacgcggccaagattccttttaaaatccctgaacccgccaaaatgccaatcaccggaatcattgccgcggtcataacaccaatgacaccactaatgccattacgcacgtggcttagccaattaacgtcacttgatgcctcctgaaccggtggtactggcactccgtccgcaaattcaggccctagttgtgcgatcactgcatcaaaaacatcgttgactgccggaccaatcacaacttgatactgaccaccggcctttgcaacatcaatgacgccgtccaagttcgcaataaccgcatcgtgcgctagtgcttcatccttcaaataaaatcgcaaccgtgttatgcaatgaatcacgctattaatattttgctgcccgcccacattagctacaattgccgtggctaatgccgagtacacgcgtcgttgactgcggtaccgctgccactaccggtgacgcggttgttgtcactgttatcaagtgagccgttgcgacgactgcaccggccgcgacagcttgtggcagtggggctagcgtcaagtcagtgagtacccgctgagcgttcgtcacgacaatgatcaccgtggtcggtttgtgggcctgctcgatagcagctaaatccatgtcgactagtagtgtgccagccgtcacctcatcaccgaccttcacgtgaacttcaaacggtgccccattgagtgccaccgtatcgacacccagatgtaccaacacttcgaggccagtcgtagtcaccatgccaattgcatgtttggttgttgtgactactgtgattcgaccactaactggtgccaagatgtgaccagctgtcggctgaacaccaaatcccggccctacccttcccgccgcaaaaacaggatccggaaccgttgccaatgacaatacttgaccagtaactggtagctaaaatggatacttcatcgatttttcccataatcgtcatccccatgtaaaacccttaacctaaccttcaaaaatccttaagacgaccgtctcacgtccaatcatgatccattaaaattctatcatcacaattagaccaatctccatcacttaccatcacttcgttagggcgactaaatatcaaaaacaagtatttttccgaatcggaaaaatacttgtttatcctaacgttgattaattatttgacgtcgccattaactaggcggttgcacctaagtgtcgctttttaggcgctactttaactgcatttgcatcctcatccttaaaaccaaacatccaagttaaggcgaaggacacgacaatcgtggctgcggatgcaatcaagaaaccataaaaactaaagtccaagcccttcggattaacaaaggacgtgaagccaatcagtgaacccgtaaagccccacatattgacattcatcaagccggtcaagaagcccaccaactgccgccccaatactggcagtcacaaaggcccgaccatatttcaagttgatcccgtacatggctggttcggtaacaccacagaaggctgaaatcgttgctggccaagcaagttcttgaatgttagccagctttgactttaaggcgattgcgaatactgcgccccctgggcaaccatcgtcgctgaaacaatcgcgttcaagtaactgtgacccgtcgttgcaatatcgttggccacaatcggaataaccgcccagtgcaacccgaagatcaccaatacttgatagaagccaccaatgattaagccagaaatcgcggggctcaaattgtagacccacacaataatatttgccaatcccgttgaaagcacagtaataattggaccaaggaataatagaatcgcaccggaaacaatcacaacttcaaataatggcacaaaaatcattcgtaataccgttggaatcacccgttttagccatggttccaacttacttgcagcttagccaggcccccgcaatcatcgggaaaattgaatacgtatacgaggcaacgtgtaccggcaagccaaagaagttcgcgttgatccccattcctaaaagcgtactcgtcgctttaccacttgccatcgttacaatagctggataagtcagcaccccaccgatgattcccataatcaccggatctgcccctaactttttaccagccgtaaaaccgacgaagattggcgggaagtaaaagaccgagtcgcccatcgcattaataatcacgtacgttggtgcggtcgggctaactaaattaaacgtggtaagtaacgcaagaattccttttaaaataccagaggctgctaataatccaatgacgggaatcattgaacccgtgataacaccaattaaattactgataccccatttaactttgccccacggcgtcgttggccgctgagctgctgcggcagtctcagcaacagctttagccgtctccgaatcatttgaaaatccccggtccgatttgcttgatgatcgcatcatagacatccgtgacagcgggaccaatcacgacctgatattgaccgcccgctttggctacgtcgatgaccccttttaagtcccgcacgacgtcatcattggctttactctcatctttcaaataaaaacgcaagcgagtaatgcagtgaatcaaactactaacattctcgacaccaccaacattagccacgatgtccgcggctaactgatcatatttacccgcttttggtaatcgattctgccgcttagcattaaatgtgttggcgttcagacggcccgtagctgtcacgtcaccggcagcttttgcccccgtaacgacgtccaacgattctaatttatcactagtgttagtcactgctaaaatcactgtggtctgacgattagcggcttgaatagcagctaaatccatggtggcaatcacgtcccccgcctgaacatcatcgcccgcggccactttgaccgtgaacggggccaccctttaagtcgaccgtgtcgattccgagatgcactaatacttccaaatgatcatcaggcgttgtgaacccaatcgcgtgtttcgtctcagccaccatcgtgacctgaccactgactggtgcaacaacttctccacttgaaggttgaacgccaaagcccagtcccatcataccggctgaaaagaccgggtctttaaccttatttaacgcaataacgtccccattgaccggcgacaaaattgttactgtttgtgcctttgccatacccattcctccattcttaacctaacaacagcgcaaccgcttgatagggttgcatcgtcaattgtgctgtgacattaacatcttgataattggaaagtaacacctgtgcaccgaccatttcttccggaagtgtcaccgttgttgactgaccataaaaattattaagcactaataacttttgttggtgatatgtccgccaatagccgaagacttgcggatcatctaagcgccacgattgataaccaccatccgcgacgatcggcatcgtttttcttagcttaatgagccgttgataatagtcaaaaatctcgccactagccaattcatgggccacgttaatcgtcgcctgattagtcggtgtcaaccacggtttaccagtagtgaaaccagccttggcactatcatcccattgcatcggcgtccgcgagttatcgcgcgccttggtcttaacgatcgtaaacgcatcgtgatgactgtacccactacgaattaaagcccgataagcatttaatgcctcaatgtccacgtaatcagccatattgtcatagtccggatcagtcatgccgagttcctcacccatatagataaatggtgtcccacgcaagaggtgaatgaccgtcgccagcatttcagcggacttgacacgataacgaccggcgtcaccaaagcgattcagcgctcgtggctgatcatgattattccaaaacaaagcccgccagccaccaccagctgccaattccaccggcccaactatctaataattgcttcaatcgtgggaagtcgaaggccattcgggaccacttccgtccatcaacataatccgtcttcaaatgatggaaattaaagaccattgagagttcgtgattagccggattagtataaccaacactgttcgcaacggttgttgaagacatctccccactgtgacgctatctacatcctggccgaagcttgccgcgttcaattcctttaaataatcatgaacaacgggggtgtcagtatacaacgtcttgctagggacccccttaggtgcgtccaccaacttctcagctttaccggtaacgttgatgacatcgaaacgaaaaccccgcacgcccttttgccgccagaaattgacaacggcggcacacgcttgtcgtacggccggattatgccaatccaaatcggcctgagtcggatcatataaatgtaaatagtacaaaccagtatcaccaaacggcgcccaggccggacctaaccaaatttagattcccaattggtcggtagactaccatcagccttgggaggacggagatagtaaaacttctgatacttctcatcacccgccaaagccttttgaaaccactcgtgttcagttgaagtatgattaagaaccatatccaacatgaccccgataccatttgccttcagctttgcaacgagttcttcaaaatcagccatcgtgccaaacatggggtcaatatggtagtaatctgcaatatcgtaaccgttatcattttgtggtgagacaaaaaacggattaaaccaaatcatgtcaatattcaactttttgaggtagtcgatcttttcaataacacctcgtaaatcaccgacgccatcgccattgctgtcgtaaaacgacttcggataaatctgataaatcacttgttctgataatttcatgcgctatccctctcatgccacatcttatttcttagaatctgtttaaaatctttttaagagtaatatcaagaaagcgagaatgatcatttggcgacttgaattaaggtgccgctcacaatttttccagagccgacgacatttatctaaccaactgaaagaacgctcaataatccagcgttgtggtaacacttcaaatttatgtagctcattgcgtttagccacctgtacggtggcttttaaattggattgaacagtggcggcgaagttgtccccggtgtacccaccatcaacaagaactgatttaacttgttgtaaatgttcacagtttagcgctagcatggcactagccccatcacggtcagaaacattggcagtagtgatatggattgcttgtggcaaaccgttaatatcaacagctaagtgacgttttattccagatattcgtttaccaccgtcgtaaccatgatgcttggcggtatcagtatttttaacactttgggcgtcaattattataaaagatgttttagccgagcgtgactgtttttcccgtagggtaaagacaattttttttaaagcattgatccaaaatagaaggttcatcaaggacttgttcttcagaccatactcgataataataataaaccgattgccaacgaggaaaatcaactggtaactgccgccactgacagccggtttttaaaacataggccaccgcgcaaaataagtcgtaaagatcatatttccgtggtctggttgattgtcgtgcaccttctaaaatgggacggactagttcaaattgtcggcgagaaatattactgggataattcattactgatcaccttttttgaactatcataccaaattagctagattttaaacaggttcttagttcgccgagcaaaatcgcggaaactaaagcggtccgcccggtgtcgtgattccgtatactggaacgctcgcgcatccgtgaggctcgtcacgcttcgaacaactgccacataggcgcccttactaatagcgaggtgttcgcggtcctcatcagttgccggcgccatcgtaatttccttcgtcgcgtaaccgatcgtcaacccaagctgattttcaaaatacgcgtacagtgagtcttccgccgcttgcttgggaactttcggaacgatcgatttcaaaatataatccttatcaataatagctggttcgccatcgatcactcggactcgtttgatggccgtcactggcgcttccgtcaattcggtaccaagtgacgtaaagtcagcaaccggtaacgttgcatccggttgatagtcataaacaatattttgcgtcttaatgtgtaacttttcggctaactctttataactcacaatgccagaaactggaaattcatactgtcgatgctcaatcacaatggaccctttaccacgaattttttgaatatagccatcctcagccaatgtcgctaatgctttgcgcccagtctcacgtgaaatcccatatagctcacaaagttgatgttcactcggcaaataactcccgatcgggtaaacctccgcatcaattttctggagcaaatcttgataaactaaggccgctttattcacggcaaccacccctttgttatcgttttcatttatgaatatagacttgtttagacaagttgtcaatatttaagtaataacccaattaaatttgtagattataccagccagatcaagtctagacatgtctagagttcacaaaatccgagcttatatttcagtattcaataactgcttcataataagtgccagcacctatacagtattggttgaactagcgaggatagtccgcaccataataaaaatcgacattcgcagagcgctaacagcaatctccaaccaatgtcgattctatatctgatgatttcattaatattactattttcgcaataaatctttcgctttcattgttgctacttctttttcatttttctctttcggttcacgagtgcatctatccagataccattcagcacggctccgccaactaacaatacggttactattgataataaagagacctcttttgtaaaaaacaatgtaaataataaagcctaaaaagccagctcccggaattgccccaaaccaccttggtaagtatcgatctaacatatagagcactgcaacgaccaacataccaatcagaattcctttaaaatcactcatgttgttcctccctaaagtcagtaataatctgttttgctacctctaacgataatttctcatcgattaccaatttcataaccttcgtttcaaacgtatttgcaccgttgtcctcaataaagttaattttttgaataatcgtgtttaaccgcattcgcacggttggataactcacttgataaatcttagcgagttgttttagagaacctgaggcaataaccaattgtttaacaaattcctgatcctcacgttctaaattcacaaaccagtccatagcatccctctttttaatattgtttattaaactttaacattgtttattataatgtcaataaaaaagcatatatttgataactgatacaatccggagatagctattcaaataaagacgagtactctaatccaaaagaattacagtactcgccttatttagaatattaacgctactagtctcagtaaatttattagctgacctttagtgattcaatccaaatgcctgattatcactagcatccgcgctagctgcatcactagctgcttgttcttcggccatcaaccgagcgcgttcatgtttgttataccaaggtgaaacagtgaaagccaagacatcgttcatcagataaacggaactattaatgaacattgctagtgtcgccgaaccttgacggaacgagatgaaccagaggaccatttgtgctaaaccagaggcaatccaccagaaatactggttgttgtaacggaggaagcaaataacgccggccgttaaacaaatcgcaaaactaatggcatcgacccatggccggggatcatcagttaaggcaccaataagatagccggagatggcataaacaactaaagttgcgacaattgcgacgatccacgtcttacccgtaaacttccgaatctttgaaaccatgttgacgttccaattagcacttaatagtactggaatatcaagcgttacgacgtaggctaattgttccccaatgcttaaatagttcttagctgaaaaaccaactacgatgaagcaagcggcggagatgacgcctaataatccattgactgacttagccgcattaatggctaacacacaaagaacacccaaagtggtcccaataaatgttaaaatagacaatgctgtaattggcgcacttactaacgtcattacttgacatcctaggctaaaatagaatagatagtagttctgttgtggccaaccttttagttggtgtgataagaatttaaaataattactcaaaatcatgctcctctttccgttttcatatgcggttgtaggtgtctagttggccaaccagtcacgtcacactactacatgtagtgtttccgtttgaaacaacacaatatattgtatcattatcttggccgatgaaaagggtaaaattccaaatttatattgaattgtttacaattaatccaactgcgccccggcaatttggtatttttggcgtgctgatttttttatattttttgatttcggcctactgatagcgttgtcaatatcaggtcaaaacaatgcgttttgtcgcaatacaatgcttgcagtatactggagaggaacaaacttttagcatcacaatataattaattttttggaggaacctcatgattacgcttaaatcagatcgcgaaatcaaagggatgcaagctgccggtgacatcatggttggcctgtttcacgcccttgaagactacatcaagcccggaattacgacttgggatgttgaccactttgcctacgaatacatcgttgcacacgacgctactcctggcgaactcaactttgaaggttataagtactcaacttgtgtcagcgtcaatgacatgatttgtcacggctgtccctagtaaagatatcttggtcaaagatggagacttattaaaagttgataccgttattaactaccatggctaccttagtgactcttgccacgcctttgttgctggtacaccatcacccgaagttaaaaactcatggaagtgacccataaagcgctatacctcggtattgaccaagccgttgttggcaaccgaattggtgatatcggctgggctattcagaattacgctgaaaacgaaatgggttacggcgttgtacgcgaatacattggtcatggtattggaccgacgatgcacgaaaagcctgatgttccacattatggcgaagctggtcacggcacccgtctaaaagctggtatgaccattactatcgaaccaatggtcaatattggtgactggcgttctggcgaaactgccgatgacggttggactgttcgcactttagatggcagtcttagctgccaatacgagcacacccttgtcgttaccgatgacggtcctaagatttttcatcattcgataatgattttgatgctaaatacttatggaataagtaatatcatttaaattataatcacgaacaatcccaccctagtttagtcacttgctaatcagggtgggattgttttagttattatcaacagcacgttcactagctattgtcagaataaaactagttatatgtgtcttggaaaacgtcttgattataagacatgaaaaactgatattggataaattttaacatctttatcctcggtcacaatcaactgattcaaccacctaatatatttattttaatgacaaccgtttggcaaaactaacgctgattcaataacgttctcagccaatcttcatcttttaccgcttattgcaaatcgtcattcaccacttgacgcgctcaaaatcatcttgtatagttagtcccaattaatccagaggaggatcagacatgactcaattaacaagtagtgctttgaataactgttgttgccgaactgcgcgcttatcgcgatgttcggcctgttaagcattgactttttgaggagtgtcatcctaaaaatcaatgtccagcatggctggatattgtactgggcgcgaggaattcattcgaattctcgcgcctttttgtcgcttttggcaccccaccgcagcgattggaggaatttatatgctcattcagcacgttcaagaacttatcggccacaccccctgatggcgttacccatcgaggttccaaatcacagtcacatctatgccaagcttgaaatgttcaaccccggcggcagtattaaggaccggctgggagcctatctgattgaagacggcttgcaacggggccgggttaacgccaagacaacgattattgaaccaactgctggtaacaccggaattggtttagccttagcaactcaagcgcaccacctacgtaccatcttagtcgtcccagaaaagttcagtatggaaaaacaagttttaatgcaagcattgggtgctgaaattgtttcatacacctagcgaggaaggaatcaaaggtgccattcgcaaagctgaggcactagccgcaacgatttccaacagttacgtccccatgcaattcaagaatccggctaatcccgcggcttattaccacacactggcaccagaaattctggcggacatgctcgcacctataaccgccttcgtcgctggagccggtagcggtgggacatttgccggagtagcggcttatcttcaagcccaagattcagcaaccaaagccgtagtcgttgagccagaaggttccattttaaatggtggaccggctcacgcacatcgtactgagggaatcggcgtcgaattcatcccaccatttttcgatcaggttcgcatcgatcagacactgaccatcgcggacgatgatgcctttgcccaagttcgacacctagcccgtgaccacggtttactgattggcagttctagcggcgctgcgctagccgctagtttacaacttgccaccaaccctgcctcgccaatagtcatatcgtgaccatctttccagacagtagtgagcgttatctgagccaaaaatctatacgaaatgaggactttaacaatgaaatttgaaacccaattaattcacggtggtatcagtgaggacgccactactggcgcgacttcggtacccatctacatggcctcgaccttccgccaaacaaaaatcggtcaaaatcaatacgaatattcacggacgggaaatccaacccgggccgccgtcgaagcattaattgccaccctcgaacatggcagcgctggcttcgcatttgcttctggctccgctgccattaataccgtcttctcactattctcggctggtgatcacattattgtgggaaatgatgtctacggtggcaccttccgcttgatcgacgccgttttgaaacactttggcatgacttttacagccgtagatacgcgtgacttggccgccgttgaagccgcaattacccccacaactaaggcgatttatttggaaacaccgacgaacccgttattacacattacggatattgctgccattgcgaagctcgcgcaagcacacgatttactgagtatcatcgacaacaccttcgcctccccatacgtccagaagcccctggatttaggcgttgacattgttttacacagtgcttccaagtatctcggtggtcacagtgatgttatcggtggcttggttgtcaccaagacgccagcacttggcgaaaaatcggctacttgcaaaatgccatcggtagtattttggccccgcaagaaagctggctattacaacgtggtatgaagactctggcattgcgcatgcaagcccacctgaataatgccgctaaaatctttacttacttaaagtctcacccagcagttgctaagatttactatccaggcgatcctgataatcccgatttttcgattgccaagcaacagatgaatggcttcggcgcaatgatctcgtttgaattacaaccaggaaatgaaccccagaccttcgttgaacatttacaagtcatcacgctcgccgaaagtctcggagcattggaaagtttaattgaaattccagccttaatgactcacggtgccatcccacgcacaattcggctacagaatggcatcaaagacgagctgattcgcttatcagtcggtgttgaagccagtgacgatttgttagcagaccttgagcgcgggttcgctagcattcaggcagattaagctggtgtttcagacggctcgtgccattctcaatcgtgaccccgccgcgatcaatttgcggacagttatgttgacctatcctggtattcacgcgctcgcctggtaccgggttgcccattattttgaaacacaccgtttaccattattggccgccttgctgagccaacatgcggcccggcgtaccgggattctgattcacccggccgcgcaaattggtcaccgggtcttctttgaccatggtattggtactgtcattggtgcaacggcggtcattgaagacgacgttacaattttacacggcgtcactttaggcgcacgtaaaaccgaacaagctgggcgccggcatccctatgtttgtcgcggtgctttcattggtgcccacgcccaactcttgggctctattacgattggcgccaacagtaaaattggtgctggtgcgattgttttagacagcgttcccgcccacgttactgcggtcggtaacccggcccatctagttgccactcaattgcatgcttatcatgaagcaaccagcaatcaagcttgattcttatcaaaactgtggcttataataaccggttgttgatatcagttattgtatcaacaataaaacgtacttataaaatcaaaattgattttataagtacgtttttacgttactttgaaaattcattaatttcatgttgcttatcaagtgacaaccaccgtcatcagcgaattagttctaattgtccgtcactagccatatccgccaaaaccattttctttagtaaattcgggcgcatcattaactgtcgcttgcgctagtatcgccgtagcaattgcaaaatccgttgtttttgtagtgaccacccctcaatcaggccagtaataatgccacttgcaaaggcgtcaccactgccgattctatccaagatcatcaatggccgagctttgccgacaactagttgttggtgctgataactaaaaccagcaaaccacttttgctggccaatttgataacgataacttcccgcaaaatagtcaatgtgataatcacgcacaaattgttcatagagtgctgcctcggatttacgatttgcagattgagtgcgatcttcgtcatcgggataatctaataacgccgtcaagtctcgtttactcccaaatacaatatccacatatggcagaatttcctgatatcgcgctttaagcgtctcatgggcgactccgtattgagctgctgacgataattgaaatcaaaacaaacgcgttgtccgttcgcatgagcctgttgtgctaaccgtagcgcggcttggcgaactggcgcagtcagactcagcgtgataccgcagatatgcacaaactgacagccaaccaacgccgccgcaatttcctgatcatcaggaggctgctgacagaatgcgctactgagccggtcctgataagtgacccgctccggccgcgacccgtacccaagttcgacgaaataagcacccatatgttgtccaccaaaggtaacgtagtcatcctgaatgccatatcgtcgaagttcgcccgctgctcgttgaccaagtgcattgtctggcagacgactcagtagtcgcgtgcgataaccgaagtgtgtcaaactacttaatagattgacgccagtgccaacggtgctcattctcagctcatcagtctgtgtcagcattaaatgttcgggcacagtcaagcgaagtaacacttccccaaacgctaggattttcataagtcaccgcccattagaattgtttctattatcgtcagcaattgggcgaccgcttccggttgcgtctcaccagtagttgcatcgataatcgaactgtatacatggggaataatctgccgtaccccagcggcgaccgcaatctgtacaatctgttggaaattagtgagatccagtccaccggttggttctagaccaaattcattgtcagcacacgccgcagccactgctttaaattcttccaggtgagccgttccttgcattggaaagtacttcagtgacgtcccgcccatatccttgagcattgtaattgcggttgcaacgggaatattcgcttttgctgactgcgaactaagtggccccgttgccacattgaccaaaccgacttcaccactcggcgcgactagcccattaatcacagtatcggcttgacctagcaacgcccggctagtcgccacaccagtaaagacttgattaacatgttgtggctggatttctgcggcaactcgcgccaccattgcactttgtttagcggtgaaccagcacctaaaccaaccgaaactgcattgttcactgcggcttggtaacgccgcatatcagtaatggcagactcatcactcagatagtttttcgtgaggacacccaacaccacgtgtccttccgcagctgcataacaagcttccgcgttcgtcactgaattagccaatacattcaaacaaatcccatttggtaaataattaggtgtcagttgcatgtgctttcctcctcaataatggttcgtaatcgttcaacaatttgtgtcatttcagcacttgtcaaagcgcggatatcaaattcaatcagtccttcgttaacacgatattctcgtggataaatggctggtcgaccttgccgtaacgcctgacagattttggccgcttcagcaatccgcacactcgctctaaaaatatcacgcccagcgccgtcttgaaccatttcaacctggacattcggtagcgtttgtaattccgcaataaagggggctaagcgggtagctttcatcgatgcgccactctcgggaccggttgttaaatattgttcgacggcagctaccaaaccaagaatgttttccttaccgatcttcatggcccgaccgataccgtagttctgttgtcgtgcccattcgacgtacgtttgacgtcctagaaccagcccagatgccggccccgaaattgccttagcgccactgtaaatcacaacatccacgcctaattgtaaataccgacgaagatcgccttctgccgctgcatctaacaccagcggtaaatgatgatcatgcgccactgcggggcatccgcaatcgttagcatgctcttttgaacagtatggtgactcttaatgtaaaggattgcgaccgtttgtggcgtgatctgcattgccaactgctcagccgtacatcgattagcataaccggccaacacgggttgggctcccgcaaccgcgagcatcacatcaacaggggccccataatcaacatcatgtccaagtggcatagataacctcccgttgcgtaatctgcgttgtatatggatgagtcacatgataggcgttaccacgaccaataataccggccagcacttgcgcaataccggccgaagcagaattgacgatcaacgcgtcctcactgccgattaaatctgccaaataacgacccgtctgaacggtcagttcggccatttcaaaaaagttctgggcgccccgcttttgggcggccgcaacttgatcactgacttgagaaacgcctaaaatcgtcatcttcccatccgcattaattacgggcttcaacccgtatttctcataaatatccatgtattcactaacgtccccagtgagtaactatctcaccgatggcacggtttcctttcgtcataattagtttcacttgtctacaccacacgtgtagacccttccggcaataacactgtatgtgggtatgacttgggtgggcgcaattcgctcttctcccgttgaatcaacaacgatctggggagcgcgtcactgtctgaaagattgtaagatcagcatcgtaaccccgacaaagctgccccttatgggttaatttgaaaatacgtgccggattggtggtaatcataggaataatttcctcaagccgatatcctagcaatagtagcttttccacacaaactgccagactataaactggtccattcagacggttacgataataaatatctgaacttaatgtttgtggaaataggtgtgcggtacgggcaagcgctgctgttcgaaaactgaagctatcggtcccatgaccgacatcaaaaataaggcccttttgatacgccttccgaacatactgtgcgacttcacccgtggaattcacaataccgttcggcttgccgttaaaacagtgtgttaagacatcgccaggccgcattaacgcgataatagccgccaattcaggggattactaccaatatgaaccattaacggcaaccgagccgtcagatccgcttgatattgtttcgctatttctcggagtggctcgacaccattgtcgccaactactgatttactgacccgtactttcagtcctacaataaagtctggataacgttgaatcgctgttcgtagggctgaaaatgaaagctgggtcaaatcggccagctcatcttgagccacaatgcccgtacgcgcaatattaagcaaggcataaacattagtagccgctcgatgcgcccgctggtacaaatcagccacattatccgcaccggtggagcccgcatcaataacggtggtcacacccgttcgataaccgattgcatcggcgtcgtcataataaagcgccgcgtgcgcattgcagtgcgtatgatcatcaatccagccagctgtaatatagcatccctgggcatccaaagttggacagccgactgggacagtcagttcagtccccacttccgcaatgactccgtcagtgattaaaactgccacgggcgcaccgctaacatctcggccattatgaatatataactccagtcatgagcgacctcaaaggaaaatttcgcccacggcccgattgcatccaataatacgagttggtcaggattgatcgttgccaccagattcttccgagtatctgtgtgtggctgttgcacaatttgtaattcatgttgatatttaccgaactgctcattgccaatcacaacatcaccgcgttgaaaagtgtgccggtcatcgttgacacgattaaaatcatgatagcgtttgcgaacctctgttgaccgaatcgttatatcgttgatatcgccacgccgctcgtgcaaattatcgagtaagatctggcgttctacgggctggatgtccgcactaggggtcaccgcaaacgtgatttgatagcggttaagcgcgccgagcttttgcaaatcttcccgcttcgcataggcgttaccaatgagcacactatcaattaatcctgtcgaaaagaggtgctgtacctgtacttgtagcggccagtcacggtgcatctctaaaagttggtaagccatcattgatatcccatggaccgattgttgcgcctggcgccgtgacaaacgctgccgtttcaattccagctcgtttgaaccggcgtgaacacgcaacgaaaaatcaaagggcaaccccgtcccacgttgcggataaaagttatggcagccgtaaagaaacggtcgattggcactgtatgacaaaatattagacaaatactcaacgtcgttactcatgttcagttcaagattaagttcctgtgagttatacgataaccaggcttcttgatgcccatcaaagccggcgtctaatcggattgcatccgctcctaatgacgcaaaatagcttagatcctgataggacacacctagttggtcaaaaatattcggggacacatccagggtcgtggtgaagcccagctgatgcgccgactgaataatccgctgatatttctccgtaactcgttctttaccgtcttgtacttccaacatactgacgaacagtcgcgtaaaacccataactggcagcgacctttaaataagcctggtcgcgttcaaagacactgtgatctgggtacaacgaaattcctaatgtccgcttcgtcatccgcgtttcccccgttccattgcttcaaaaacttggtagcggttcgcaataattgttgcaaaataaatcgtcactactatggcaatcacagctggtaaatgaagccagccgactagcccgaccgttacaaggatactcagtaaagcacgccacaaagtctgacccgttcgtgctttgatcaaatatgctggcatcacccccgactcactaaccattcactgccgattacgaatgctgctaatatcaatattccaaacatgctatccctctattctttgctaagctgttgcttctcaaacactttgaaaaacggataatagataacaaggtcaatgacaaagttaacacaagagagtatcagcgccggaacactccaatttgtactaataaacgcaccgagtggttcccggaacagtaaacagtaacctggccatcatcatcggaacgacgccggtgattgtcaacacgtaagctaagcttccagtaattaaaggaccaataataaatggaatccctagaatcggattcatcacgatgggtgccccaaaaataatcggttcgttaatattaaacagaccgggtaacaaagacaacttgcctaaatcgcgcaaataggtcgatttagaaaacataaacaacacaaccaacgctaacgtccctccggctccaccaatccaaataaaccattgcaaaaattgttcagtaaaaatggtcgacagattatgggcgctcgtgccactagtgaactcgctcatattttgggcaatcgacatttcccagaacggccggataacagggtccataatcgcagccccatgaattcctaatgtccaaaatccagtaatgagaaaaatcgtcagtagaccaccaaacaaactattgccgaccaaaacacctttgagggggcatcagtagcgtgcttaaaaatgaggaaatattaaagtccaaaagatagcgaatgccccaaaacaacactaggataacggcagctgggactaaggctacgaaggaattagaaacttctggtggtaccccttctggcattttaatggtaatattgcgattctttaaataacgaaaaatttctaccgtcaataatcccgtaataatcgagccgaacaacgacgaggcactcaagttagcaatgttaatgtatcgcccactgctaatgacaccgctaacatttttagtcacgtgaactggtactgcggtcgacacgagaaatgctaagacggctaaaacaccattagttaatttatctaactgataactttcggcaagtgaagatgcgattccaaacgttgcgtacaaggccaagattccaaccgtataacgaaacggcacgtccaaaatttcagcgtaaggcgccaaaaagttagccaccgcttcaatcggcatattattttgagaatggtaaagaacgatccgacaatcgttaatggcagcgttgagataattccttttctaatcgcggtcatatgccgctgcgtgccgactttattcgctactggcaaaactttagcatttaacatgttgataaagttatccatattacaccagtcatacaaatatggtatgcgtagaagtcttagtgtcctccgcgccaagaaagtttgtacatttcctttcatgagtttaccaatgagtatattgttaattacgcaacagcagcaatcctgaccaaccaatgctgctacggtcgctgagctaataatcaacatccgttccaccccatatttactttctcatggaacagattcagtgctggtttcgacaaaattcacgtattattttcagaatggcgttccctccttttggcaaacatcataacattataatgttatgatgtaaaaaatagtgaaacccaatcgtattttaaacttgttggttgggccaactgatatataaaaaacaccatttttatccctcgcctatctctaaatgtctgaacacaccttttaaggtccgctgaaataaggccattgccccagcattaacggcaaggccccagacttcacccaacatattcggcaactgttatctgcatagcatccgcctgaactaccgacctgataaaaatgcgctgaccaccacagtgcatcagcgcatatcagaccgcgtatcggttcaatttataaaacgtcataatttatttgatacgggacaacatccgtttgataagtcgcaatagaaaattcaactagccgctggtgaccatcataccccttacgttcgcgccgaattgctaatggcgtctgactttcaagcaacgcccgctcactatccgccagggtgacagcactgaatttatcttgaaaatgtgtaatcgtctgaccattctcctgtaaaatcttatacagtgaacgatgccgaagggccgttagtttagtaggaaccaaagtattcggtgcaaataatgatcgacaaccgcaaatggttttccatctaataaataacggcgcttaatacgtaacatcgtcccttgagactcgctgggtagcaatgcggggacagctggcacgcgttcaattttgatcaactctttggtcaactttccttgctggccgaccgttgccgtaaacgactgcgtctgcgtcaacttgttaaatagatcgttactaataacgcgcgtgccaataccactcttcttctccaagtagccctcactgaccaaaacttcgaccgccttgcgaatggtaatcttgctgacttgatagtaacgttcaagttccccttcacttggaattaagccgcctacttcatagtcaccatctagaatccgtcgtttaagatctgcggcaactttttgatatagaatttttgttcccatgctatcgttacctttcacgtacataaattattaatataactctattacatttcgatctaaaacaccagattacaaaactgtccaaaatcggtttattaagcggacttaacaatcaagtttggccgtcagactctgtcagcacttcataattatttgtataaataattttttttgagtgccacgcacaaagtcttaataaaaaataaggcctatcagtggctaaacgtgctttcactgatagaccttattcataaatatttaacgacttatttagccaataaacttcgctgcaaattcgctgaattgcttaccagcaccagctaagaatgattgggtgccttcatttgtgatatgaccattttcatcagccaacttatcagtattaccgatgtacaattctggttgttgcatcgttggcatgtctaagaagaccaaggattgacgtaaaacatggtgtgctaagacgccagagataacagagatcgattgggaagcaaccaaagcgggcttgccgccccaaacactttgaccccatggacgtgaagcaacgtccaaagcattcttcaaggctgctgggatactactacggttatgttcaggtgtgacaaagatgaacgcatcttgagccgcaacggcctgacgaaattctgtatattctacgggtgaatccgcatcgtagtcttggttatatagtggcaacttagcgatatttaagtacgttacttcagcgtcgtctggtaacccagcaacgatggcttcagcgacccctttagaataagaatttttacgaatagaacctacaattacaccatattttgtcatatcaaacaatcctttcaagactaatttcttcgtttcacttactaatagtaagtatatcaagttgttgaaaaagtgcaaccattttagcctatcaattttcaaaatcacttgttcaatcgccaaaaaacgttgttaaatcaagacttacgctccagaaaaatattttagtctatgtctaattaccgacagaaaaggtcatcggagtatcaatgattccgatgaccctttctttattttcaatacacgtctaatcgtcacgcgtttcagcgcgatatttgatcaactcttcgtttaaaccatcaaacatctaagaaatcttgataatcattatcaacttgttcaacatacgccgtggcccatttagccatggcttcatcaaacttcgccgaattaccaacgtatccccgaatcatggccgccgttggactttgcgcatgagcctttgccaaaatcattgcgcacgtatttgcataggcttggaattgaccccagtctagggttggaatatcgatggattccttcatatcccgaaattgacggacataaaaactcttattttccatttggaaatagcccaggaacgcatccgaggttgcttgtaaaatgcgttgcgaactgacgatccgttgcccttccgtcaattccatggcggccgttaacgctggccgcgactggctcccgactttccgcgttggtaaagcttccttgatttgtaacaccatatggctaccatccgtactcgtcagaagaaccaagtaacatagtgacccaaaactcccgacgcccacactatgccgaataatatcagtaacttcatattgcgacaacagcaaagcgacatcggtccgtacgttcaataaatactcgctaattccggcctttagcccttgataagtttgccgatcaatatggacagaacggggcgcgttctccttaaattgccgttcaccgcgactattagtgaccgtaaacttacgcacaacttgttctgaattacgtttttgagcctttttaaccaaggatgcaattaaatcggccgtatcttcgggagcaccaccgaagttcaagacagcctgaacttcgttatcgcgataaaaacggtctaacgtcgtctgatcaaacatccgtttgagtgcttcccgataactcgcactcgccgcctgtatcaatttttcgaccttttttggtttaaagttagaatcacgagcagctagcaacacactaactaataaccgacgtaaatcccattcccacggatgggacgccagcttcgtcaaagtcatttaagtcaaataccagtcgccgttctggtgacgcatagaatccaaagttaccaatatgagcatcgccacaaactacggcgggaatttcagtggacgactggtaatccaaatcgtaatccattaactcaactgatccccggaagaatgcaaaagccgaagcggacattcgttcacgccgcaatggtaatagttctggtaccagcatctcccgcacatgtttcagataatcactggcgtttcgcttcaccggtgtaaatgtccctaatttttcaaatggggtgacttggcgccgcgcctttcctagcgcaattaattcagcaaccgtatgatgttgtcgaatatgagttaaatcaagtggtggcataagtatcaaatccttttatgatttactaattttattatagcgatatcttccaacgatagaaaataattcagctagttgagcccgcttctcgcgtcccaattattgaccagctgagcgccaatttacaagcaattttcatgataaaacggcgattctagttgacgtacccctcaaagtcacctacaatttaagttataaatgataccgctttcaaaaagcgaggaggtcacgtattatggcaaattctgaaaaaacattggtcctagttaaacccgatggtgtcagtgaaggacacattggtgaggttatcacccggttagaacgcaagggttatcaaattgccgccttaaaggttattaaagcaaccgcggagcaacttcaacaacattacagtgagaaggttggtaagccttactttaaggaaatcgagacctacatgatggaaggtccactcgtcgccattatcgtaagtggtactggcgtcgtcaaagcggtgcatcgtttagctggtagcacccggcccgccgaagcacaacctggcacaattcgggggatttctctcatgaatatccagacggtattttacgaaatattatccatacctcagatagccgtggaaaatgcgcatcacgaaattgcaatttggtttcccgaattagctgtcaaagcacgaaaagcagacaacaaagtaaaagcctagcttcatttttaacatcacgattacgcaattcgcaattactgatcaatggtctgaacgccattgcgtccagtaattgcgaatttgtatacactgggtgttttccgtcacaacgttagtaaagcttccaaagataactcgtaaactggccccactaactaccaacacgcgccgaaattttcgcactaatcgttcgcactagttatgattaaaccaatcaactaaatggtttggggaatcattatgaacatagtcgttggaccatatgtacggcggccgcgggctgtcaaatcggacccgcgcaacaccagtaaattttcgatgtttaattcgctacgacggattgatgaatgcctagtcttgattaaacgtactggcacaccaggattaattgattcaactgcaacgttaggtttgaacctaacccacttaatgggattgaatgtcatcgtaactagtcgtggacgttccttcaccatcattgttcaaggtcggcagcggtcgttcacgctgactggctgtctcattgaagacacgctctacaacgccgttcacccagcacaaccagactatctgatttcactaaatcgccagctcattaccaatagtgatgacttaattgagcaactctatgaccactattagctggccagcatcacgcaccaaaggctaacccaccgtgtgggttagcctttaaattgccccatattaaatgatcagttgaacgactttaagcagtgtcgcggatggtttagccggaatcttcatcttttgaacggctggcattgctgtgtgaacattttgggcgaccggacccacttgcgagcgttgccccgaacgactatgcgcaaccaatacggtattatccgcattccgcgcgtatatcacactattagtagcatcttgtaaatcatcactcataaatctgggtcatttggtgatgatagaccgcgctgtgcggatcgtctggctgaattcgctgtccggccgcaattttgcggatatgtaacggggttgcctcgttgatgacccgagtccccttcaggtgtagccaaacttgtgcggcttccaccttagctgccggaaaatcactaagttgtggctgacggattgccttaaacgttgctgcggtactacgctgcagccgacgttgatgataggtccggcgctggcttgtatgccgttcaagctgcacttgttcccacaccaaacaagcaccaaagaggacgatgccgacccgtaatgcccaaatcaattttttcaatgattagcccccactttaccataattacgctacttaatttaacatggtcttagctaattatattggcaaagccggtaataatttaattattaatagggcagtcgcaccaactcgccatttctagttgcgcttccccttaaactattaacgatttccctaacttgacagctaaactgatttattgtcaaaatcactatttaaatattttattttatgatggcaatacaaacattttgattatcgcgatatacttagacgagcattagctttttcaataaggaggcactactgatgaactcattcaagaacccacttatgacaacaccctatctgctagccataatcgccacactgacgatgctagttagtccactgacaacggttgttatatcagtactgatatggttgtcgggaattacgctggtgtggttacaccgccagcaacgatggctccgcttcttctacgcacccgtgtttttgtacactttttactagaacaaaggtatttctccccatcaacccagccactgacagaaacgattctcattaacctcgcaattcttggcattgccattttcagcacatgggcagcttatcaattacgtcataacgcgtaaattactcaccaagaaaaataagtccccagatgcggtaaaccccgtttctggggacttattgattgcttcaacagctaccgttaaataacgctcgttaggcgggcttcacttcggctagtttttgatccagatatttcttcaatgctgcttggggatgaaaaccaaccaccttttcagcgggctggccattcttgaatatcactaacgccggaatactcataatctcaaattgttgcgcaattttctgatgttgatcaacgtcgagcgaagcaaatttcacttgcccatcgtacagttcatctaacgcttcaagcactggttcctgcatcttgcaagggccacaccaatccgcccaaaaatcaaccacagttaacgcggtaccatcagccaccgtcgcaaaagtcgtcttatcgactggttcgatcatatctaatcctcatttccaattgatttccgttctatcatagcatgttttcccacaaaattatgacttccgggtctgaatcacgtacataggtcacaaaatcttggtatatcggtgttctaccaatcaaaaattcgatataatagcgttatagaaacgatataacctaaaggaggaatttttgtgtccacacaaacaatcagtcccgaacaggactccgaattagtcgcttccgtcgccgctgaacaactcggtattaaagccgtgacgttgcgcaaatatagcaccatggttgaaaaacagcttaacgatgaaaatcgcttccgcccggccgataacagtcatcgcttatatacagccgctgatttaaaaacttttcaggcggccatcgaactcgccgaacagggcacaacgttagccactgcgctaggacgggcgtttggtgctaaggtcccgacatccaaacaaccggcggcaacgacgactcagtctgagaaatcagcgcccgcaactaccaccaagtcgcccctcatcacgacaaccaccgtcgatcccagcaaaatggcaccagcggccaagccagatggcccgactaatgctgagctctataaggcagcaagaaatgatcatccggcgcttagattcactcagtgaccgcttaaaccaagtccttgaccaacttgatcaacaagccagtcaagcggccaaaccttggtggcatttttgggaaaagtagccatatgctggtcaacatacttgctcatcagacttacttcggtagggcaagcattacctaccatccaaattaacgcgtgctgccagtcttaaaaataagctacctaccgttcatcgttccagttaactcgcccagcgatggctgctatcaagtggctctttgtcaggcaagacgcaaaaggcgcccagaattaaatttctgggcgccttttgcagctaattaccatggcggttagtaattagtttttatcgaactactttgctgcagctaagtgcttttcgtacgcagctttgatttcattaactaaatcttcatctttcaagtcagttgtttcgcgaatgacttgttcgattggttcatccttcaataattgttgtgtggaaacttaacactttcactatcattaggatagttgaagaagaacatttcaccaactgtatcaactaaggcgctgtaatcgcgaccacgttccttcaattcccgaattgggcgaatgaaacgttcgttgaaacctaatttccgaattggtgtccggccgacccgttcaatatcatcagagatatatgggttttcaaaccgactcaaaatcttcttttgataagcatggtgtacttcaggatcaaagccccacttttgaatcaacaagtcgccggtttcacctaaaacgtgcttagcttggtcaacaacactgtcatccttgaccgcttcgccaatcgtcttgtagcccttcatgttaccagtataggctacggtggcatgaccagtattaacggagaagagtttccgttcaatgtatggttccaagtcgtcagcataatcaacaccctttaattgaatcttagggttttcatctgggacttgtcgataacccattccttggaatggttcaactgaaacgaacaatggatcatcatgcttttgaagcggtacgatccggtcaacagcggcattagggaagcccgcattttggtcagcccaagcttgttcgtcttcatttaatgattcataaacggatttctttaatgactgactcccgccaatcatgttttcacaagcaatgatatcaattggtgtcgtattgttgttagcttgccgtaactttaacccgtcagcaattaatggcgcgatgaacttcaagatcttaggtccaatcgcagtcgtaaccatatcggcttgggcaatttcttcagcaaccgccttaggatccttaccgttgttaatacccttaacatcgtgaacttcaatatgtttttgaccttctgcagccaattcaatggtataaccattccgtttgtttaattcgtcaatcaaagtatcattaacatcaacgaaagtaatcttaaacccgttgtcagccaaggtttcgccaatgaagccccggaccaatattcccgcgccaaaatgtacgtctaacatgctaatcaacttcctttaatagatttatgatttcatcttcagattgagcgtccgctaacttagcaacgttggcaacgtcgctgcagtatatggcaatctgagacaagaggttcaagtgttcaccgttcaacccagcgatcccgaagataaccgttacagtcttatcatcatcgttatcatctggattaccccagctcacacccattggtacttggaccacggaaatcccggtctttttaatatacttcatgccatcttcagtaccatggggatggcaatgaaattacccatatatacggagacatcctgattacgagcccgcattgcatcaatgtattctggttcgacacaaccgccatcgaccaatagttgaccggctaagcggatgccttcttcttgcgtagccacttgctggttcaacgcaatcattttcttatctaaagcttccattgttttcacccttacgctatttcgttagttcgttcaaaaatgctttactaattaattgataaagttgctggtgatcgccagtcataaacgtctgcgtattggcctgactttcaatgactagtgcgcttaacttacccatcaaccgattttcaaaatcgctgatattggcgggcccgagcattaggacgattcgctgcaaccgaatcgattggttgtccatactcttaaatggtaatggctggtcaagttcgaaaatcgcacaatatggtgcggtgacttcctgacttaacgtatgcaccaacgccaagttcgtattgggaataccgaccggcgccagtcctaagcggtgtaacaaccggcccgcaacttctagcggatcatgaatcaagttcgaatcaatatgccgcgtgatcttaactagcatctcggccaccgtctcatcatcgttgcgaatcggcgtgatagtgaaacggtctaagatctgtttagcaatcgtcatctgttggtaaacgtgtgtcaaaatccaagttgattttcgtcggctcatcaaccggtgaatcgatcactttggtgcttggaaaatactgatgaatatattcccgtaaggcagtgacttcgttttctagtaacagtgggctgacaacgcggtaattcaacttaaatcccggtaacgttgtcgtggataaaatcatgtcaaagtcttgtaaattaacttggcctaaattaccaatccgcgcaacctcgatagccgtgatttcaggtactaaccgcatcagtcgcgttttcaaaattcgcgccgtcgtcatcccattcgggcacaggaccaaaaccttgagtgcttggtgactcaactgttgctcatacgtactagcaaagtgaatcaacaagtacgtcaactcatcagttgtaaaatcctggtctttaaaaatcgttgcgaagccgcgcaccaccgccgaatacagcttaggatactgttcacggacctcttgtaactcagcggttggcggcacggggaccattaacaccgttacgttgtagggcaatttgcatatgcgccgtcaagttattcaacaagcggtcatccgtcccaaacgaccagttaaagttagtcgcaaccgcgtcaataaactttttgacccgatacgttagttgcaaatcataattcgatagcgacgcgtcttgatcgattcgaaacgtcaagcccttaatttgctgggcgagaaaatcaatttcagctcccgtcaccaccgtcttaatctcagcgggtagttgggtcataattgccagagcaatccgttgatatttcaagaaatcatcccgattgatcccgcgcaaatacgtgacccgacgttcatgctgtaaccgcattactcccgtcgtcaacgtgatgatcaactgttgtagctgaccatccggcaccgaagaaaagtactttttcttcaaacttcgcactgcttgataacagataatcaacgtttgggcgtccagtaagttcaaaaaatacgattgctcatcttcacttgctgatattgctaagccttggttcaacttcccgattgttttaaaaaactcgtagtcgttgatttcattattcaaaatggtggcaaacagattgcgaatactaccctcagtcccagccacctgaatccccgggacttcaaccgttcaattgataagtcgtagtcagcgaatggtgttgctaatgccgtcaaatcgtttgaaatcgttgcaacgctcacatcaaagtcaagcgcaagttcttttaattttacggaatggcccgtcatcagtaaccgacaagctagggcgttttgccgcgtttgtgagtcaaacgccggtgcaatcttccgctctgctgtcaattggctttgaaacttggccagggccgtctgcgatccacttagttgaaagtgatgcttctcattaacaattttcaaatcagcattggctaataccaattccaaattactgaactcgcgataaattgttcggcgactactattgagaccggtttcaatctgatctgactcattgaaaggccggcgggattcgctagtagcagctgtagcaactcatcttgacgttgtgtaaacttaaccatgatgccacctcatacgataatggtaataatatcattttatttcaattctgataccatcttatcatatttaggtgaactcaatagatcgtcagtaattaatacttggacctcgcgtgtaacgggtctttaagtttttagctgcttctgcacttgaaacaactaataaactattattatcagccaattcgtcaattcctaagttcttaacactcacatgcttgttggctttcttgacccgatccttcatcaaggacgttgccattgtggctgttcctaaatgaccatcgtggtgaacaaagacaatttcatcaacaacactcaaatctaagttagctggtaggtcgtcgggtgcagccgtcgttgcttgtggtgctgcggatgcgggtgcagcatcgctaacttgatcacgagcctttaagttaaccacaacttggtcatactttggactactcaagaagttgtcaacggctaaccgtaaggcgtgtggtgctttttgagccgcccgatcagctaattcgttttgcgtaatcactaataaaccaggttcgtctttcaaattgctaatcgccgtgttggtgacggacatgctaatgccagccttcttgactttatcccgtaataaggaagcccccattgcggatgatcccattccggcatcacaggcaaaaataatatggtcaacatctttgtatgaagcaatcacatcagctggttcagcgtcagtcgcactagcagcttcagcattgccactcttcatgtcgctcattttaccttgagcagcggctaagtcatcatcaccggtcgacttgtcacgtttcaagacaattgcggcaacgataaatgatgctaaggttgctaacgttaccccgataattaaaccaatgtagttagaaatactctttggtgacattaatagtaatgaaataatggaaccaggtgaaggtgttgaacgtaaaccaacgtttagtaaactgaatgtggctgtcccagtaaccccaccagcgataacagctaggaacaatgctggcttcattaatacgtatgggaaataaatttcatgaatcccaccaagaaaatgaataataatcgcactgggtgcagaagccttagcagtccctttaccaaacaaggcaaaggctaataagaccccaagacctggacctggatctggttctagcaagaacagaattgacttacccgcactagatgcagcctgaatcccaagcggtgttaagataccttggttaatcgcattgtttaagaataaaatcttggctggttcaatgaagacgttggctaatggcaatagcttcatcttaatgatccagtcaacaccggcagccatagcagcacttgcaccagcaaccaatgggccgattgcaaagtaacccaggattgctagtaacatcccgataacttcccagcggagaagttgttaaccaacatttcaaacccgctcttaatcttatcggaaatggcgtcatcccacttcttaatgcaccaaccgcctaaaggccccataatcatggcaccgataaacattgggattgaagaaccaacgatgacccccatagtggcaatcgcaccaacgaccccaccacgatgaccggcaaacaaagtcccaccagtaaacgctatcaataatggcaataaataatggaccattggttgaatcatcttagctaatccagcattaggccaccaaccaccagccataaagatggcggtaattaagccccaagcaatgaaggcgccgatgttcggcataaccatattacttagtgcactcccaaatttttgaacgcgtgccttaacgcccagtttctttttcgcaacaggagcgctttgggttgcattcgtatttacattttcactcattaggtaaagctccttcctttttcttaacaacttaatcagatatccatcgtggtaagcggtttcaagaacttctagttagacccgtggcacaggaaactgtgccacaattaaactcactaattcacaaagttaaaatttggcacagtatcgataaacacttttatatcggcaataccagcagactaattaaacttgtttcgtcagctatgatttcattttcacaattaaattcaacattttatgcagaaaacacctggcaattctctcatcattttattatttaaatgattacgaatacgatttaacgttgaaatcccctcgcaagctcctatacttataattaactaaggagtgacctatgtaatgaaaaaaagatactgattgtaccgaaatattggttgggaaagctgctagcatggatggttcgaccatcgttgcccgcaacgaagatggctacggcccaattaatccgattaagtttattgtgcacgaagcccacgaccaaactaacgccagctacacttccgtaactaccgggcgtcaccgttccgctgcctgaccatgcctaccgctacaccgcaacccccaagccgatcaaagcgatgggcagtacgaggaagctgggatcaacgaattaaatgtcgggatgagcgcaactgaaaccactgccaccaatgcccgcgtactcggttatgatccgctcgtccatgatggcgtagatgaagaagccatggtcaccctcgttttaccctacattaaaagtgctaaggaaggtgtccaacgcttaggtgccctaattgaaaaatacggaactggtgaaagcaacagtatcgcctttaacgatcacgacgatatctggttgttcgaaaccgctggtggtcaccattgggggcagttcggatgcccgaagacacctacgcaattgttcccaaccaaaccgtggtgcaagagatggatctcaacgataccgacaatttcctaggtgccagtgatttagtggacttcgttgaaaagtatcacctcaacccaacaccccggtcactttaatttccgtgaaatctttggtacccaaagtgaggcggatgcttattacaacactccgcgaacatggtatggtcaaaaactatttaatcccgaaatcgaacagaatcccactgatcaaaacataccgctattccgacaaccaagcaaaaaattggctattgaagacgttcagttcttcttatcttcacactataacgggacgccttacgatccatttggcactttcgcttctggtaacgcccgtgaacaaacacgttaccggtctatcgcgatggatcgcaatcagtgctcatctattctgcaaatccggaatgacgtgccacgctaagcaagccgccattcaatggatcgcactaggtttcttcgcttacgccccatacgtgcccttctttaccaacatcaatgacacgccgattgattatcgcaatacaactagcacggtcagcgttgataacgtctactggttatcaaaaacgctctccgtcttcttgggattgaaccacactggcatgaatttgctgaaacggtcaatgcctatcgcgacgggtgccaatcatatgcccgtggccgggttgccgcaaccgacgcagccattgccggcaatccgaccgatttcttgaccaaagccaatagcgaaaccgccgccgaaatttccaaccggacccatgcgttgtttgatactttggttaagcaagggctgttgttatcgaaaacgacttgggaaaaaggacaaaatctatgaataagccaaaaatgattcaactgctaactatcctagtagtcgaatcattttttactttacatgagtacttattaaaaagccgtgcttcacaacgcaatcgttatgaagcacggctttcagttcatttttaacttaattaaaattaatacttcttgcttaacttgctagcagccgcttcgtcaatgataacggtaacgtctggatggttttgcaagatacttgctggtaattcaggggtatctgggccttctaatcatacccttgaccgcatcagccttgttttcgccgaatgcttcgagcaataataagtgcttgctcttcatgatggaagctaagcccattgagaaggcttgcttaggaacatcattttcgctggcgaagaaccgcgcgttagcttcaatcgttgattcagttaaatcaaccacgtgcgtcgtaatatcgcgaggagtacctggttcgttaaaaccaatgtgaccattacggccaatccctaagatttgtaagtcaattgggtgttcgtcaatcactttgtcgtaacgcttaacttcagcttctggatctgaagctaaaccgtttggcaagaatgattccttaaatggcttgtcattgaataaatgagtttgcatgaagtatttataactttggtcgttgtctggtgcaatcccaacgtattcatccaagttaacggatgtgcagtcactgaaatctaagtcactattaacgatttctttgtaagttgtaacgggtgttcgaaccagttgccaacccaaatactttcgcaccattgtctaaagcattcttaaatactttgaaaccttcttttccgccggcagcttgatcctttactacgataactttcataattaactgactccctctttgtttggtatagtccaattgtatattggtctagactaaaattcaagaggtttgtctgaaatatttcacttttattttttgcaatcgttatcattgttaaactgtcaagccaaactcctttaataaattaattgtatttttcgataattttgcctatacttaacatgttcgtaactccgtggaacgtgagaaattccacgactagccaaggctgcaaagtcattggctatttttttgcgctcatacctctacgccaaccatttatttgttcacatttcaatcaaactatccaatatttacattgcaattggtaacggctaaaattagctttgtatggaagatatatattacataaagggaggtgttaaaccgcgaatcatgtcaagcaataccggttaatggccggcttctcacaaaaagaactcgccagcaagactggcatcacccgtcaaaccctgagtttgattgaaaagggcacctataacccatcactgaaactatgcctcaacctctgtcacgtactcaaccaaacactcgatactgtcttttgggtcgaacccagttaggagatccccgccatgaaaaagattcgtgacgaacgtttaattttacaaaatttcaagaacatccgtaccacgttgttaattgaaaatagtgctatcttactgattttattttggcaaggctggcaaaaaaacaatcttcagaaagcctttacgtacgacaatccgttgtatattgtcctgatgattgccgtttttaccatgatcattttgtctgttaatgtcagcaccccaatagaagacaaacccaaacggtcatggcgctaccttggcctgtgggcactcattgaactaatcggtttcacctgcgccctattctacttcctgattgcgataaatcagccgttcattagtctgatcgctggtatcgccctgaccaccgtcactagcggtatcatgctgtatagcaaccacgcgcgatcgtgattaacatcagatatcacctagacggtaccattctaatcacatttgcggtaaactattcccagaaattcaacggacacgaggtttttgctatggaaccaacttttaacaaaatgactgcgaccggctaccatgccatcgaacaggaaattgaagacttaaagcaacaacggcccgagcgaatcagaattctggctgcggctgcggcactaggtgaccgttctgagaatgccgaatatagtagtgccaaacgggacttaggtcgcttagaaagccgccgcgttatctcaacaagcagttgcaatacgcccaaatcgttcaaccagctgacaacaatcaactcgatatcggtaaattcgtgaccatcgaatttctggatgatcattgaccaaatcacctatcaattagttggaaaacaggaagccaatctcgaacaacaaaaatctcattcacatctcccatcggtcaagcgctcgctaatcatactgttgacgatgtggtcactgtgaacgcaccgaacggggcttatcaagttaaggtaatcgcggttaagcgcgcgtaataaaatagttatgccaatcgatcggaagcttatctttatttttttgaatcaaaaatacactttctgaagcgtatacgtgctaaaataaaggcagtaaaaaagccggtacgttaataccgacttgaatcaaggcccgctctaagagcagttggctttaaatttagataatcaaagaacagtcacccaataccggccaaagttttggggtggctattttttgtttctggagttccatacctgatacatcgctagtgcgatgctcaaaatgatttgcaagaaagcaaaccgaacaggtagagtgaccacggctgaaaacctttccttagtgtgggaaacgtatttgtcatactaccacgacctttcaagatgaaaacagccaatcgctactgcaccatgtattgcgattacgctgatatcacaaaccaatcatcaacaagcagttgcccataaaaagatagcgacgagttatcatcacaacgtcgctatctttttatatcattcaaattaaaattcttggtacactgctggatcttgattattcaagcgaccatccacttggctcaaaccattaattgttgccatatcagctgcactgatttcaaaatcaaacacgtccatattacccgcttgacggctcggcgttgacgactttggaatcggcaaggtccctaactgtagttcccaccgtaaaatcaactgaccaacatttttatggtagtgcactgcaatctctttgagcgtctcattttgaagcatctcactggcccggccaaggggactccaatcttgcgtcaaaataccgtgtgcttgatcataatcccccatagttgtgcctcgctggttaaagtacggatgtaattcgacctgattaatgacgggtaaaacacccgtttctttgtttaatcgttctaaatgttctggtaagaaatttgagaccccaatcgaacgaatcaagcctaacttctgggcatcaatcagtgccgccaagcttcaacataatgatcttccttagggttaggccaatgaattagatataaatcataataatccaggccagctcgatataatgattcttgaatcgtattgatagcttccgtgtaggtgtggtggcgaccaggaagttttgatgaaatcaagagttccgaacgcggtactgacgaacgccgaaccgcttcaccaacagcaccttcattttcatagttaaaggccgtatctaataatcggtagccgcgatcaatcgctgagtcgatcacttgcacaccatgagcaccattcagtttatatgttccaaagccaattttaggtactgttaaaccatcacgtaacgtataagtttccaacttaagccacttctttcttttaaattaaacgatcattgttaaatttatcgttaatcttctgaacgatcagccaaggcatcacgaatcgctgcttcaaatgttgccggccgtgtcgttggggcatagcgttcgagcacacggccatcacgaccaatcaggaattttgtgaaattccacttgattcgaccatgtcccgccgcctgtttgaggtaagtaaataacggatcagcgtcatcaccattaaccatcacccgtttggtcatgggaaacgttaccccgtagtgccgttgacaatagtcatgggtctcatcgtcatccgccttttcttgatgaaattgattggatggcaatcccaagaccactaggccctcccgctgatacttctgataaagttcttctaatcctttaaactgtggcgccaggccacagttgctagccgtattcacgattagcaagacctgaccgcgatattgtgacaagtcaaagtggcgcaccactcatctcagtttctgtaaaatcatacactgattctgccatcgagatccctcctaagaatattaaccaaatacattgctttatccatagtaaaccacaaaattgtgacttttcatcatactttgctttagtttccggaaaattgattgcactgaatgtcattatccgttacactaaacgtatcattcatagcaactggggtgccatcacggctgagataatacccattgaacctgaatctggacaatgccagcgcaggagcaatgcttttatttggggaaccatcaattcagacttagccgcccgccaccgataatcgtggtaggcgttttttgtcgcttggatgcgtgaatgacaaactacttttgggaggatttaacaatgaaatgggttaaatcatggtacttgaacgatattattttactggcactaattggtattttctttggtgccatctttatggggactaattttgtttataacattttaagtgcggccctgacaccatttggtctaagcggtctggctaatgaactactacttggcttatggtgcatgcccggcatgttagctggctacctcattcgactaaagggttcggcaacgctaggtgagctcctcgcagcaaccgtcgaaatgtttttcggtggtcaatggggaatcaccacattgatttctggtgtcgtgcaaggatttggggccgaactaggttatatcgtcactggctacaaacactatgactggttaggcttaacggctgcggccgcaacaactactgtggtcacctttggctgggaccttgcccgtaatggttactataaattacagctatggctcttgattttatacgtggtcgttcgctttatttcgatgtttgttttcggggtctgttaactaaaaccatcacggacctacttgatcgcagtcatgttttaaaatcaacgcattaatacactttataaatggaggctttctcgaatggctagtatcgcgctgaataatttaacttacacctatccacaggcgtcgacacccattctggatcgcgttaacctaacactaccacggcaaagcttcatcctattgacagggccatcgggaacaggtaagtcgacgctcctaaagctgattgcgggcttactacccctgactccagattacggcaccattacctttgatggtcagtcattaactgctagcaccgctaatcagcgcgctcagcacgttgccatgatgtttcagaatcctaatcagcagtttgccatggataccgttgaaaatgaactaattttcgcacttgagaacttacaagtgccccgtgaccaaataccggcccgcttacttagtgcgcttgactttgttggtatccgaaatttacagtcacgactattaaatcatttatccggtggcgagaaacagaaagtggcccttgcaatcattgtcgctatggatagcgatgtcatcctactagatgagccctttgcccagtgtcgatccgaccgcacgagccgtcttgttagaccgactcgtggaactacgcaatcaacatgggaagacaatcatcttggcggatcatgacctaacaggttacgaacagctcgtcgatcaagtcgtccaaatcaaggaccagcacttacagctcattgatcgcaccacttggtctgagttatttgcagcctttactgagcagccacaacggtcatggtcagcaccgcaacgcgttgaacgcccttgttttcaacttgatcacgtcactttacaggcgggtgatcgtcaactattagtaccgacaacgcgtcaattgttagcacaacacaatacgctgatcacgggtcctaacggtagcggtaaatccacgttatttgaagccctcgtccgtctgcacccttatactggtgaaattcgttacgaagggacacctatcgacaagctaaaacgcaaacgctatgctcgccacgtcgccttgctttttcaggacgctgagacccccagtttttaaacatcacggtcgctgaagaactggctcaaagtaaacgctatgcgtatggcgactactttaccgcagaccgtattcaaacggccttagtgcaactcaacttatccggtcgtgatgaacaagtcatctatactttgagtgagggacagaaaaagaaactacaaattctgctcatgttaatcatgcagtcaccagttctactcatggatgaacccttaaaagggctagatttgcattcgatcaatgccctggtcgcgttattacagaccacccaagcggcaactaagcagacgctgattattattagtcaccagttaaccggcctgatgccattgattgactatcagctacactttgaaaatcaccatttagattgggtggtgcgatcatgaatcctagcatgaaattattattactactcatcattgcgctagaaatttcattcacgacaattgtaagtttgaacgtggcactgattattctggcactgagatttacccgctcggtcaccgaactcggcttcgaacattagggtggttgctactcattccgttgctaccagcaattggactttggagtacccagtacattaacggtagcggtgacaagactttgatggcctgggtcctgttcacacgaatctatgcgtttgtttttacgggcgctacttttacgctcacgactgacgtcttacaattaaccgattcgcttgagcaaaactggcatttacccgccaaattttcatatggcgtcctcgccgcgtataacttggtaccacggattcagcacgaagttcaagtgattcgggctgctggtctgatgcgtgggcgggtcctgtccttctggtcgccacagctctactttaaagcaattttggtctctatcaattggtcgcagaaccttgcccgggccatgcgctcccatggctttgtcgaagatgcaccccgcactcactatcgtcagattccactgactaagttggattggaccattgtgtgattagcggcgtcttgcttttacaagtcggcgccttcgtcattccgtggcgctagtggtctcattcactgaataaacactaaattaaaacaggttttctcaattatgagaaaacctgtttttgggtaatattccccacttaggtcgggacacaacaataacaagttgaccttaattcatgctttcagccgatcaatttgttgccgtaacgcctgaatagcagctgtagaagacgtcgggtctgccattaattgatcatacttgaactgaagtactgctaagtcagcttctaccggttgcggcgctttaacaactttgtcaggatcaactaattggtgcgtctcgaattgcaacacccgagtagcaacggcctggcgaaacggttcatcatgtgaaacaaaaattacggttccaggataattttgtaagtaatcggccaacgcatccagcgcgtccacatccaaataattggttggttcatctaacattaaaacgtttatattgaccgactaaaatacaaattagctgtaatttaactagttcaccaccacttaacgccgatactagttgcggataaaatcgtgctggcgggcccaacgcgcccatgacgttacggatcgtttgatccggtaactgactgacttgccgcaccgtttgccacactgactgtttaccgtcgagcactgtcatatcttggttgaatactccgactcgtgccgccggagccaatcgtaatcctgacacccggccacctaaaattgcacgcagtaatgtggtcttaccgctaccgttgggccccacgatagcgacccgatcatgtggcctgatttgaaagtcagcgtgtgctaacaacgtttttccatattcagccaatgtgacattaagaccagttaccacggtcttacctgtaaacgtcggaaaatctgtcgcgactaacttaaagcctgaagtcgtaaagggcttagcaacttgcggttcccgttgtcctcgggcgacccatgcgtttagccgttcgttccatcttggccgcagtagcttccctagtcgctttcgtcttggcacgctctacttgcgacattcgccgattgccttttcgaatccgctgggctttttcattacgttgacgctgcgctgctagtaactcacgctgatgagtgttttggcgctgatacgcggcttcctgagttgcgagttgctgcgcttttaccgtctgataatatgcgtaattgctcgcatatgcggtgaatttttggtgttcaaccgcccaagtctgtgtcgtcacagcatttaataattgccgatcatgtgaaatcaacaacagcaacccacgaaaacgttgtaactgattaataagccattgctgatgtgttttatccaaattagatgacggttcatctagaattaaaattgttggccgggcgctcaaagcccgccgaattctggttagcatagcttgaccaccactttggtcaaaagtcggtgcgatttgggcaacatcagctgactggctcgtccaccataatttgtcccgtataatcacgatcagtacccgtcagtaaatgggccagtgttgatttaccagcaccgttccgcccaaccacgccgattttatccccggcattggcgactaatcggtcaattgtaaatagtggccgtcccgccatatctttttgaatattttttaaattaatcattgtcattaataagcatccccttagttgcggggactaatttatggcacaaaaaaacgtcctcaaaatgagaacgctggcaattgattccaccagcaccctaattaatcccaaaacggacagtccacccctatcgctaggcatggctctgttcagttactagaattaattagttgcgcattggctgaatacctcgtgttttataagttactttgtagattagcatgtttaatttcaatttgcaagaaccattgtttttaaaagttttttcagtaaactaaaattactttcagaaagcggtgtcagtcaccttgaaaaagatcattgcaattaccggcttcgcaatgctaggtggtggtctccgggaggggcttagtttgctcgtcacttggccacagcatttctggataacgtgtctgattaatattgtgggagcatttgttcttagcctgattactaacttgttaccagcgcggttacccgtctctgaagatattgttatcggtatgagtgtcgggttcgttggtagctttactactttttccaccttcacttttgaaacgctacaatcgtttcaaagtggtcatagcgttttagctttaagttatgtcgctgctagcttagggttgggtttgctagcggggctagctggaaacttccttagcacctattggctaccaaaggaggaattttaatgttagtcctagtcggattggccggtgccggcgcagctgtaggggccttaagtcgttacggcatcatgcgcttagcactacctctcaatcgatggccgttaccaattgccacgttatttatcaatctaaccggcgctttattgctcggttggattttaaccagctcattaccgcccaactggcagatttttctaggaactgggattatgggtggctatacgactttttcaacaatgatcaacgaactcgtgttgctcggccgtaaccaccatcaacgggtcgcctgggaatactttggcttgagtctcgtcggtggcctagtcatggtttatctcggaactttaatctaactcaaaaaacaggaagtctcacaaaactaactgagatttcctgtttttgttcaatgactatttagttccaacaagccgcctttacggctagcgtgccgatgacactagttttaacaacgctcatctttatctttcaaattacgtggtggcatttccgaataatgcaacgccggcaatcgccacgacgatcaggcctaaccataatgcgattttaaataaaaacaacccaatcacaatcatgaacacccaaccgataattttaaaaaccaattttaaagataactttgagcaaccataaaccaattactaaagcaatcaataaaccgatcatctatgcgctctgcgaagagagcttccctccttacaagtcccatcatgggtaccttgccagttagtatagcacgcgctatacagcggcagactgattgcagtcgtaaattaagagaagcttaattttgcaacgccgcaacttgtcgcaccatcgctaattcttcgttagttgggatcaacatcactttaatcttggaatctgcgccactgatgagtccttcttgacccgcttcatttaatttcggatccagggtcacaccaaagatgctcagttcatcaataatttgctggcgcaaggtcgcattatgctcgccaatgccgcccgcaaaaatcagcgcatccgcccgttttaattctgtcaaatagctaccggcatacttaacaatccgattgacaaaaatttcaacagctagttgggcttggggattcgtggtgggcttcttgcgcacggatttcacgcatatctggtgaaattcctgagattcctaacaacccagactgattgttaagcatcatcatgatttcattcggatcatcgatctttaaagctttcatgaggaatggcaatacggccggatcaacgtcacccgcgcgcgttcccattgtgacacccgttaatggcgtaaagcccatcgatgtgtcgaaggcccggccatttttacggcagctaatgacgcgccactacctaagtgtaacgtcaccaggttgaggtcatctttcggcttagccagcagttctgcagcccgaccggttaagtaaccatgcgagataccatgttcaccgtaacggcgaatatggtatttttgggtcaattcatatggcaaactgtaaattgcattcatttctggtaaatcggtaaagaattgactatcaaataccgcgtactgtttaacggtcggtaaagcctgagccatcgtctcaataccacgtgcctcccaatcggattatgcaatggtgcaaagtcactaagccccttaatggtctcgagtaccgctggcgtcacttcaactgcttgcttgaacgtttcgccacccgcaacgactcggtgagcaactgccgtaatttccgttaatgagtcaataattgctaatcgctgtaattcagccaataacatctccgccgcatgattttgatctaaattatcgactgtcgtttcaaacttttgatggtcaccatacttgatggtgaaaattgaaccgggcatactaatccgttcaacgagaccactagcaaccaccgtttcagcgggcatagcaaataattgccatttcaatgatgaactaccgcgttaataattaatgtttttgcatttctcaatcaactcccatgtaatagaataccgaacttttctgaaaattgctcaacttttttcaatcgtgtcatttgacatcttaattcattcgctagtcccaatcttccactgttaactaaccagaacatgttattattaagacgttaacttttacagattagaggaacccaattaatgacgaccacaaccgatgtcgacctagtccaaactggattagcgcacttaattcaccacacgcgtaaacaaatcgaatcattaactaaagcattagaccacccgcctgatgtcagtgatttgcaactcaagggcacgttattgaagacgtatgctagccagatcgaggggcaccatcatttcgtcgaattgcccgactatcaaggccaccaactcagtattaaactcgatattaaaaatcaattattgaaaatgccgaggattattttcatcgttatcacaaaagcaaacgcggtcaagcgaccgttcaacaaaatttggcgacggccaagaccgaactataccagcaattagcaactcaagcagctttcgaccctaatgatccacaagcggtcgccgcgcttaagcaaacactgattgctgcgggcgcgattcatacccacgttttacacactcatctaaggccccaacacccgcccatccccgccgcttttacacgcacgaccacgtgctggttgaagttggtaaaaatagtcgtcaaaacgaccacctaacattgacggcccgtaaagattactactggatgcacgcgggtggtgaaattcccggttcacacgtggttattcacagtaatcatccgagtgaacaaaccttgcgaggaagcggccgtactgacggcctattacagtaagggtcgtcagatgaaccgcgtacctgttgatgtgctcaccgttggccagatgcgtaaacccaagggtgctaaggctgggcttgtcacctttagtggtcccgcacgcacgatcaccgttgtccctgatgctactttagctgctgaattacgtgaccaggaagatattcaccatgacgccgattgagacctatattgctaacacaccacaagcctatcaatcgcaattaatagccttacagcaaaccattgcaacggtctttaaccagaggcgcaagagcagttaaagtaccagatgccgaccttctattggcacgaaaacgtcatccattttgctttattcaaacatcactttggcttgtacccaacgccaagtgcaattgagacttttcatgatcaattaatcacctataaaacaagcaaaggggccatccagtttccgctggatcagcccctaccacttgaattgattactgctattaccgaattccgtcgtcacgaaatcatagcgaaatacgacctttaggattaccgctgccaccaagactgtttaagaaaatcaatggcggttacgtcactcaacgcaatcggcttaacgactcccgcttgttgattcaaaaaaagctgctggtcgtccacagccgcaattaagccactcggctgatgaccatcacttaaagttaaccgaaccacgcagtttaactcataagcttgcaataacgacgcttcaattggtttcagctgttccattagatcacctcatcgaaatagtagctccatcatagcacatttttagaacgtacgttcgataaaaactattacattttgatgacgttgataaaccggtcacttgtaccaatcagtaatttcaccagctaactaattatgccgttaactaccgaggttaccgaacattcgcccaaattattttaaaattgcccggattcggtcagttgaagttagcgcacggctatggctcagttcaaaacatgaccgtcattaaattcaaaaaccgccagcttagaataagtctcgtatttgagactgggcgggttcgggctcaaatcgatgtcggtttacgttccagcaattgtcgctccgccccggaggtcggaaatagggcgattattgctgaagaacaggagtctacctaacgagcctaagagtgagctatttttgaccttaataaacaggacgcgctaataaaaggccactccccggcatattggggagtggcctttaatgcaatttactttagaatcgctggtaatagcttttacttcatcatcactaaaggttaaattgcgcgttgcttcaagattagcgtgcaagtggtcgacattggtcgtaccaatgatgacgctcgtgacgacctgtgaccgtagtagccaagccaaagccatttgggccaaggtttgtccccgttgctcagcgattctgttcagggcattcaactgattgacaacggctgcagtcccctgatcaaataaatatttattcgttcgatgaatcggaaaatcggctggaattccttgtaagtagcgctgcgtcaataatccttcagctaatggaccatatgccaccaagcccgcattatgctggccgagatagtcaatcaggcccgctgtttgagcctgttgattcaacatgttatatgagtactgattaaccgtaaacggcgtgtgcatctcattgaaatacttaatcatcgttgccgtttggtcgcggtcataatttgaaattccgacatacaacgccttcccctgactggacgaaccaactggtcaagggctgcggcagtttcatacaaatcgatgttagggtctggacgatgtgagtagaaaatgtcgacgtaatctaaatgcatttgcttaagactacgatccaatgaactgatcaacgttttgcgtgagccgaaagccccatacggccctgaccaggccggatatccggctttagtcgtgatgacgagctcatcacgatacggctttaaatctcgttgcataatttgtccgaacgtccgctctgccgatcccttcgatggtccataattatttgctaaatcaaagctaaagacgccatgatcaaaggcatctagaaccacttttcgtgaattgacaaacggcgcttcatccccaaaatttcgccataaccctaacgagacaacgggtaattgtagccccgtcttacccacgcgtcgaatcggtaattcgtcatagcgcgttgatgctgctgaatatgtcatcattactcacctcatctaatttttgaatactatttatattataccgcgcctgtaatattggtactgatcaaacgcttaagcggatacaaaaaggcgatcctcgccaaatgctaggaccacctcacttaggagtttatatgtgatgtctgctgttgctgcctaattagactttgatttgaaataaggttcaacagtgcgtggctatttcaaaccaccatctattgtagcccggaatcgcccgttcgttaagtcattgcgcgtcagaattgaggtaggcggttataatatgctaaatattggcgaccatggacagcatccaccattactttagtgacgctcgtattagctggttccggtaagctcatcggatcggtcggctttagtatcgctaaggccatggctttgacggtaaaaccatgggtcacgacaatgatctgctcgtctggatgggcttgtgctgttgtcttcaaaaatgctgctacccgttgttgcacgtgctcaaaagtctcgccatccgtcgcaacctccacgtagcttggcaaaacgtcctgtaaaagtggatcaaagtactgcggataggccgctagcaactgatcattatcctgtccatcccactggccgtatgaaatttccaataaccgctcgtcctggctaacaggtagttgccggccttgattcaaaattgccgccgtggcctgggtccggtcaagcgggctacaaatcaaccgatccgcgaagctaatgtcaaacgtatcgtgcaacgtttgcgcttgctgcttgccaaccgaattcaaatgcgtgacggctgtattaatcgtgccttgttttaaattttgggcgttggccactgtttgtccatgtcgtaccacgtaaaaggttgtcatcgtgcgcctccaagattaaattattattaataatactaattgtgccacagtcttttctcattatctagcttgacaaatagttacgtgcttgctaaattaataccaacgcaattaactgactggtgccaacaccagtttaaccgaaggagtgtccaactgatggttctaactaatcctatcaatcatcatatcagttcctcctggtctacacacccatctgtgtcggcctaattttgcgtacgcaaatcagcctgagcacggatgctaagacattcgctaccaggtggaattgcttaatctcgttattatccgtcctggtagtcgaaaccgactgcgaggactttttattaccttgattaaactactgaaagcgaggatttttcatgccaatttataatttttctgctgggccagccgttctaccacaaccagtcatcactcaaattcaagcggagctaccatcatttcgagactccggcatgagcattttagagatctcgcatcgctccgatttatttgcgcaagtccttcaagatgccgaacaagatcttcgcgatttaatggccattcctgacaactatcacgtgctcttctttcaaggcgggggcacgctacagttcacagctgcgccactaaatctcggcgcctcatcatcgtatcgggttgcttgacagcggtcactgggcacaacgcgccgccgatgaagctaaacgggtcggtactaaagtcacgatactggggagtagcgctgccaaccattttaaccaactgccaacggtcgtccagcccatcgatcaatccctcgattatattcatcttacaactaataatactattgaaggaaccatgatgacgcgcccgccagttacgggtcaagtaccactggtagccgacatgtcatcaaactttttaggtgaaccttaccaagtcagcgattttgggctcatctttgctggtgctcagaagaatctgggtcccgctggtttgacaatcgtcattgtccgtgatgatttaattggtcaagtcgccaacccgccaagcatgctggattaccagctattcgcggctaaagattcgatgttcaacacgccgcctgtttttgctatttacgccgcgggtctcgtactcaagtggctaaagggcccccaaggcgggctcagcacaatgactgctcgcaatcacgctaaagccgccttactctatgatttcttagaccagtcacaactatttactaatccagtcaagaccagcgaccgttcgaccatgaacgttccattcgtcacaggtcaggccgacctcgatgccgcagtcattcaaggcgcccgtgagcacgggttattaaacctaaagggtcaccgcttagttggcggtatgcgtgccagcctctataacgccatgccgttagccggtgttcaggcattagttgactatctagccgcttttgaagcacaccatcgttaatcaaggaggatatttatgtatcaagttaaaacctataacgccatcgccccagccggcctcaacacgtttactgctgattacacgctcaatcaatctgagcatccggatgcttacttaattcgctcggtcaacctacataccgagacattaccgtcatcgttgaaagtcattgtgcgcgctggcttgccggcgttaacaacattcctatcgatcaggcaaccgccaacgggactgcagttttcaacaccccgggaagtaacgctaatgccgttaaggaactcatcatcggcccgctcattatggcatcccgtaatctaatagctgcaacgacctattcggcccagcatacagaagctgatatttctcaacgcacagaacacgacaagacgcaatttaatggtattgaattaacgggtaagaccttggccgtcatcggactcggccatgttggcgctctcgttgccaatgcagcattgagtctaggcatgaatgtaattggttacgacccctatctatctgcagatgccgcttggaacattgccaaacaagtccagcgagcggccacgctgccagatgcagtcaaacaagctgattttgtcaccgtccacgttcctaaaaatgccgacacacttcatctgattaataaagatgcgttagccgccatgccaacaggcgttcaattatttaattattcacggctgggcatcgttgacaatactgccgtcatgaatgcgttagccacgggacaagttgcccactactacaccgattttggcgaaccccagcttgccaaccaatccgcggttaccgtgacaccccatatcggcggctcgactatcgaggctgaaatcaacggtgccacacaagctgcgcgcactatcatgacttatttggaaaccggtaacgttcatgcggccatcaatctgccagacttaaacgtcccgttcaacgcggcttaccgctttacagtcattcacgaaaatgtgcctaacatggtgagtcaaatcacggccaaactagcagcggccaacctcaacatcactaccatggctaacgccgctaagcaccagattgcttacaccatcattgacgtcgacgacctacagcagccacaacaagccgacctaatagctgaactgtctaaaattccggcagtgagtcgcgttcgactattaaaacggggtagcgtcgaatgaagattgaacacttacaacacccgacaactcaccaactcgatcagttaatgacaatctggttaagtggtaatttaacggcccatgactttgtcagtgccgactactggcgtcaacaagcccccttagtacgtgaagcattacaatcagccgaactcatcgtcggactgaccgacggacctgaagcttatattctgggctttataggcttacaaaacgattacattgccggaattttcatttgcaatgatgctcaacatcaaggtctggggacggcgctattggcgactgcccaagctgaccatcatcaattacaattaaacgtctatgttgctaatcgcccagccattgccttttatcactatcacggtttccgtgtcattgatcaggctaatgaccaagcaacccagcaaccagaatatacgatgcaatggcaacgttagttttcttaattaagccagtacgattcttaacgagtcgtactggctttaatttgcttaataatattaatgattaaaaaaataatattgtatttaatctaattttaatgtattctcatctacatatcataatcatttgaagcgggggtacatatatgcaatggaaattatttgccacagttgccacgttaacggcaacgaccggcgttttactcgtcggctgtggtcagtcctcatccagttcaagcaatgccggcaacacaacggccaaaatggccaggactcaagtcctcaattggtcggaaaacggccaggatttgaccacccttgacccgtccttagccactgatgttatcagtgggacgatgatcagtaattcgcaagaaggtttgtatcgattaggtaaaaacagtaaggtcacaccaggtattgccactaaaacgaccgtgtccaaagataaaaagacttatacttttaccccgcgtaaaaatgccaaatggagtaatggcgatcaagtgaccgcacaagactttgtgtatggctggcgatcgtacagttaatccgaagacggcttcccaatacgcctacttatattccggtatcaaaaatgctgacaaaatcgtcagcggcaaggccaagactagtaccttgggcatcaaggccgatggtaagtataagctgaccgtcaaacttgaaaagcccatgcagtatttcaaattattgatgggtttcgtggtcttcttcccgcaaaaccagcacgcggtggaaaaatacggaaaggactacgggaccagttccagcaagatggtttacaacgggccattcaagatgactggttggaaagggaccaactcgacctggatacttaagcgcaatcctaattactgggataaaaacacgtttacttaactaagatcaaagaccaagtcgtgaagtcgacgacgacagcctttaacctcttccagagtaataagctcgacatggcaacgttatctggacaacaagtcaagaacgaaaagaataataacaaactggtcatccgtaagtcattcacgtctaaattacttggaattcaatcaaaagaaggtgaagttactcgccaataagaagattcgtcaagcaatgtcactgactttgaatcgtaagcagttggtcaacgatgtcctcggcgatggttccatcactccaaagggctttgttacgaccggacttgctactgatccaacgactggtaaggacttcgccaccgaaaatacggttaaatcagctgttactcaggacaccaccaaagctaaaaagctctggaaacaaggactaaaagaaaccggcaagaagtcgattaccttaacgttaactcatgacgatacagatcagatgaaggccctcgctgaatacgttcagggacaattagaaaaggaattaccgggacttaaagtgcaaagtgtcaccgttccttataagacaagaatttcccgagaaattgcgggtaatttccagctggttatctccgcatggcaagctgactttgctgatccagtttcagacctcggtatcatgacatcaactaacgattacaactttggtaagtggaccaacaagactttcgatagtgctatcaacacagcaaatagtacaaccagtacaacgaagcgttggcaagctctcgcaaccgctgaaaagacgatggcgacggatcaaggggtcgcaccgctctcacaaaacgtcatcgcacaaatggtcaaccctaagctgaaaggcctagtctacaacacggcgggcattaactataacttcaagagtgcctatatggccaaataaggtgacctaactagcatcgcctcacgtcaaactacccttaaatcgcacaataaaaggtatcgtagcaacaaactacggtactttttttgtgtttcttgacacattttgcggctgttaattactttaattattagaatcaaagcattgattttaatcttgctttaatgtattctcgtgaccattcaagttgggggaagttttactatgaaatggaaagtaatgttgacaacatcctgctactgcggccgcatcgaccggccttttgttagctgcctgtagtcaaggtcagtccaagtcagataatgcggggaacttacgcacgggaatggcacaaaagcaagtcttgaactggtcagaaaatggctccgaactaacgactttggatacttcgctagtcaccgattcgatcagtgccaatatgatcaataacacgatggagggcctctaccgtattggcaataataataaaatcacaccgggcattgcgacccatactgtcatttccaaagataaaaaaacttatacgttcacattgcgcaaagacgccaagtggagcaacggcgatcccgtaaccgctcaagatttcgtttatagttggcggcgaaccatcgatcccaagaccgcttcgcaatatgcttatctttattctggtatcaagaatgccgaccaaatcaccaatggtaaagctaaagctaatagtttaggaattaaagctgacggtaaatacaagctaaccgtgacacttgataaacccatggcttattttaaactcctaatgggctttgccatcttcttcccgcagaaccaacacgccgtacagaaatacggcaaggactatgggacaacggccaccaagatggtctacgatgggccgtttaccatgaagggctggaaaggcactaatacgacatggtccctgaaccgcaatcctaaatattgggataaaaacacgtttacttagaaaagatcaatgaccaagtcgttaagtcaaccacgaccggattcaacttattccagagcaacaaactcgacatggccaccctgagcggcgaacaagtcaaaaacgaaaagaataatcccaagttagtgctccgtaagacatcccgtctgaactacctcgagtttaatcagaaaaaggtgcccgcgctagctaatgccaagctccggcaagcgatgtccttaactattgaccggcaccaacttgtcacggacgtactagcggatggctcagcagttccaaagggctttgtcaccaccgggctcgcaaccgatccaacgactggtgaagatttcgctactgaaaatgcagttagtgcggcgacacctcaagacaccgctaaggccaagaaactgtgggcagaaggattaaaagaaaccggcaaaaagtcattaaccttaacgcttacgcacgataatattgaccaaaccaaagagacggccgaatatgttcagggacagctagaaaaggaactacccggtttgaagattaccgatattaccttgccattcaaaaaccgacttgcacgtgaaacatcgggtaatttccaactcgctatttctggctggcaagctgacttcgccgaccccatctctgacctaggcattctcacttccacgaatgattacaactttggtaagtggaaaaatgctgattatgacgctgctgtcaagcgaggccgagcaatcaactgatccgacagtacgctggactgctctaggcaaagctgaaaaaaaaattattgggacggatgaaggcgttgcaccattaactcaaacaacgctggcacagatggtcaaccctaagttaaagggcctgatttataacacttctggtaccaactataacttcaaagacgcctatatggcaaaataaaccatcagctaactcacagacgctcactagcaaagactagcgagcattttttatatagtcaagatatatttttagaatatgcacgattatgtttaaatattgacaaaattatataaaaagtttttaattagggtaaatgaaagctgtttcaattatgacttaaatatgtaaaggaagcgttgatggtatgaacattgagcttttcatcgcccgccgcaaagccctaggactttcacaaaaggccctagcagatggtatttgtactcaggcgacactaagtaagttcgagaacaatggcaaagcacccgccatacgaatcgttgcccaactttgtcagcgactcaacctacaattggaagatgtctttccaaccgaacgcgtcgctgatgccgctgttttgaagattttggaacaggtcgagttcgacctcattacaactgaatatcaagatgccgaagtacaacttgaaaaggctgcggatatgccgcgacatgaccgcgaaaccaaattacaatattgttatctaaaaggctatgttgctgcccttaaccaccacccgatcagtgatgtcatctttaattttgaccaaatcatcaccgatttggacgaggctcacatcacaatctatacacagctggcctactgtggtatcgggattgcttatcagcagaaccaggataacgataaagcccagtactattttgaaaaagtacgccacgccctaccgaacctaccgctagaaacgaccgctagtgtttggcgcgtgattaacttagcttattacacgggggctttttacgctaacattaatgatacaccgcggagtttgcagttattaaactacgggattgagatttgtgcgcgattccacgttacctattacgcagcgcggatcaaattcttacaggctcaattatccgatgaaccggatcaaattcatgaatatttaaatgatgcggccgcccttgccagaatgaacaataaccggcaattacttaagaatatttcaagttattcagattctcactaatttacggttaaataattgatttttgttaataagtcgcctaaactgcaagtattaaaagacgagtttttacaactattgaggaggtcttgcccatgttattagcgggtttattggccgcagccggactagctgccgttgccggcgtcgtggctggcgcccgtgttcccgctgcccaaccagtcagaattaagcatgaccaacgcacatctcaaaatcgtcgataatgtggcgacacttatctatgatataaataaaggctactggaagcgaaattccagtagcctttttgtttaattaaatcgccgttgacgactaacaactgttagcccttaagcaagaaccagcccaaaatcattagccaatccattgattgttcactagtctgtggcaattgttgcgccgacttgcgattagttgcttttgtaactttaacaactggtttagaagttgctactaattttattggctgtcctaacaatttcgttggccgagtcgtggttactaaattagtttgcttgactaacttagctgtctcagtcttcgttgtgacaacctgatctgaatcactatcctcgtcagcgtgtcctggtagcaccggttcacttggttcactcggttcacttggttcactcggctcacttggttcacttggttcactcggttcgcttggttcgctcggttcgctcggttcgctcggttcgcttggttcgcttggttcacttggttcgctcggttcacttggttcgctcggttcgctcggctcacttggttcactcggttcgcttggttcgctcggttcacttggttcgacctcatcggcaaaaactaatttggccttgataagcgctttgctcattcaacacaagcacttgcgcctgtgtattgatcaagtaaccgtccggtgcttgaatttcgctaaccgtataagcgccttgcgttagacctgtaagctgtgcttgaccagtcgcatcagttgtcaactgagcaaccagcgttccggcagcatttttcacggcaaaaaccgccccggccaagcgattggcgccactcgaatccgtcttaatcaccgtcaatttcccggtttgatacgtattcgttaatgtcaccgtctcaccactagttgtttgactactgatatagccagcaatggccgtttcaatcaccgtataagtgtacgcattgccataaacatccgtcacatccaaatcactgaaagtgcccgtatagccatttgctgacgttaattgcaaggtctgataagcttgaccattgcgttgcaacgtcacttcaacggtcggcgtttgcactccagctggcacgtcagcccaaagctttgttaacagtcaacgccgtcttagccattcgtttgtcaaccacactacctgtgaccacgttagccgttgcttgcgctgcggataccgtgaagacgtgcttggccgtgtcgatttggtagccactcggagccgccgtctcaaccagcatgtacgtcccagccgacaagttaccgatgcgtaactgtccaactgaatcagtcaccaaatcggtccgaagtaccgtacccgtactatcctctaactgataagtggcaccagcaactggctggccgtcaccatcagttttattaatgaccaaactgtaactctgaatgtcatcactagcggttccggaaccaccaaatctaacggccacgttcgattgttcactctttggttcgcctgtcgaactgccctcatttggatcagtcgcatctccaatgacaggtgcatacgttacacccgcattattggtgtacgtatgtcctactgtcagaccaacttcataaaatatattgataccgctacatctaattggtcaatattaattgtcatctgctgacccacaaccgtcacggttacttgtggtgttgataccccatcagcgtaggtaaactgctgcgttgcaaaatcataagtgcccagtgccgcgtctttaacaaaggcaccgtcagtataatgaccagtttccaacgtcatggtaccttcgtgcgtttgataaaggcccagctgatcaacaatcgcaacttgctgccacttttcactattaatgtttgcgacaacttgccagatcattttggtgggattaccatcagcatttaaactattactatcggcccagccaaccttattaatcccagtcgtactactgccagtggttgcgctagtcccagtaacataaaacgttaagtttccttgacgattataacgatcactagtcgcataataatcattaaaagttagtgttccggtttgactaccggtctcggccgtaaaagtcccgacgaccgttccatctgagatttttttggacatcaatatgctgcgtaccattggtaaagacaacattctcgggtaaggtcaccgttgctgtactgccagcagttacgctaacatcatcggctattgaccaatgatacttcgcgatatagttcgcatacagactcaatacatccgtagcgctatacgtaacaccatcatcgtcagtcaccgttgcgtcagtagcatcgagcccctgaaccgcaaccgttgcccgttgtgctaaactgcgaagactggcccggctcattctggacagtgtcgcgacagacgcagttgcttgatccgtcgtagttgccgttctcgccgagtctttttgactggtaacgacaccactgtacatattagtcgtttgttgctgattctgggtcgttgcttgctcgttgttcgccttcgcactagccgctcgttgatccgctttggcattagccgtcgcccgggacgtcgctgtcgtatcagtactgtccgttgttgcttgagcggctgctcacacctgaagtcgtttggctagtagccgttgtgctagatgattgggttgatgactcagacgtggtgaccgctttgctagtcgccgtttcagtcgccgatgctttcgtgctactgctactgctactgctactgctactgctcgtagtttgtcgcaacaccacttgattagcaagtgtactcgagccagaagtctgcgtcgtttcagtggcagtggtagccgtgtccgccgcactcactgtttgatttgtcacaatcaatgtcaacatggcggccgttcccattatccaagttttgaaatcgattaatcgcatgatatccccctttcttatataagttaaaacttttaaaccgattacacgccttaattataaaccacattccgcaaatttgaagacactttttgtcaaaattcgtcgctcacagatagcagttacataccagcaatatttgttcaaaaggctcattacacctatataatttttatttatgtacactttaattaatttaccgatatatcaacattttaaagacatgaatcataattagtattataatattttatacaaaagttgtatgccatcaattttgacgagttcgtgacagttgttagctaattaaaataatttatgctgattaatatagatttaactaattgcaatcagtaaaaatgatgtcattcgtttcatttataatttaaacccattaactgctttagttgcttgtcaactaattacgtcgagaaacggggcagactggcgctaccgatgacacgtagaccaattattgatttatcgagcgatatataacagcaccttaactgataagtatttttatagctttattactaatagtttgccattaacttgtatgctttttaatctgcataatgtttacttatcgctttaacactttaacctttatttctaacgactcccacttaagcaatgcaactttttttccggtgattaatcagaccaaccgacacgtcatgataataatcaaaacgatgtggcagccctttaactgataaaattatataatgactcaaaacttaatttaccagcaacactacatctgtaccaatcagcactaacattcttattaataatcattatagtttaagcgcgttaactattttgtaaattaattttcactaattatcctgacactattcgttataacaatggtatgattaacatgacgtataataaccagctttaatcaatcagtcggagcacgcttaccgcgactattaattgcgcaaccaacattaatattttatggaggctacatttttcatgaacattaaagacttgtattacttccaacgcttaatcagcactcagagttatacgcaaacggctgctgattttcacgttagccaacccacaatctcccaagcaattaaacgactagaacgtcattttcaagtgacactgttctttcgccaagcaaagaccaaggcgctggtgttaacacctagtggccagcaactattagctcgcagccaacgacattatcaacaactggcagcatgtcaatgaatcaatcagtcatttgcgtcaacatacactgcggtttggtatcgaaccatccgtcagtgaacattatttaccggcattaacaaaaccaatcatcgagcaagatttgcttagtagcgtccacacggttgaaatgggggctaatcaactcgtcaaacaggttttagccggccaactcgacttagccatcagtggtaacttggatcaaacattggatgaacggctagcagtaacgccattacggccttttaaatttcgcattctcgctaatgttgcgcaccccttagcaaaggctgagcatccgacttttgcagaagcgctaaaatcgccttttgtactgcttaatgcaacttacttaaataaactagtcttccggcaacttgctgaacaactttcgattgaaccccaagttctcttcgaatctgatagcagcaccttgatcaagggattagttaaagagaacctggcactaggcttcatttccgacatcacgacccccaacgatggtgaagacgatggtctcgttgagattccgttcgacgacgttcaggttcctagcgtgcatatcaacttgattcgtcgggcccaccaatttccaattggcttggtcaaacaagttatcgacattattgaaaaaacatttgcggctgacaatgccgaacaaaaatcttaaccacaaacttgatcataatcatacatgcgctccaataaaaatacccaacttatctagaatgataggttgggcgttcttattggggcgcatttttggttaagtcatcacgattaaatttacacgaccaactcgtgctcgtaatcacacaaccgccgttaaaaatcacattcacgactccagcagcgaagctaattgtgacctaaaactggtaaactttcgcttcgtacgctcgtaatacgtcttgatgatcttcatcgtagttactgatcaacagatgcgcatcatcagcgggtaattctgcaaagtgtcgcgtctgggttgccgcagtaaagttacaaattactagcgaggtgctgcgaccccatatgccgcacataggcataaacggccgcatcatcaggtgataataggtgataagttcccgtcgttatgactggtaaatggtgccggagcttaatcagccgctgataatagctcagaactgaaccgggcgttcgttgcgcgagttgcgcgttgatccgcggataattggcattaaccgctagccacggtgttgccgttgaaaacccagcattctgactatcatccaactgcatcggtgtacgcgcattatcccgcgacatatgggcgagataacctaacatctgttcaggttgaacgacctgttcgtcatcaacaaagtgatgatacgcattcagtgattccaagtcttgatagtcggttaacttggtaaaatgggcattcgtcatgcctagctcctcaccttcgtagatgtagggtgtccctttgaagaaagtgcaatagggtcgctagcattttggctgaacgttcccgataagctggccgttcatccccgaatcgtgacacaattcgcggttggtcatgattattccaatagagactattccaggctgtcccttgtaagcccatttgccacttagacaagctctgctttaggtcaaccagtcggacgggctggtcattccacttacctagcgccggatctggattaccatccaggcccatgtgttcaaattcaaacaccatgtttaattcctgaccttggccgcttgccagttgcttagcatcagcaaccgtagccccaggcgtttcgccgaccgtcatcagttgatggcccgcaaacacttgctgattcatttcttgtaagtattcatggagatgcggaccattggcaataattccaccgattgccgcgtatggttccccagcttctggctgcccgtctgcaaagctatcaggcttggaaatcaagttaatgacatccaaaagcggaaaccgtccacgcccttattgacccagaaattcatcatgtcatagactgcttgccgtagttgcgaattatcccagttcaaatctggctgttcaaccgcaaatgaatgtaagtaatactgatcacggctggcaacatatttccaagcagagccaccgaaaaagccaccccagttgttaggttcatgcccatcaacaggatcacgccaaatataatagtccgagtacggattatccttactttgcgcactcgtcgtaaaccacttattttgatcagatgaatggttgacaacaatgtccatcatgatttttaaccctttcgcatgggccgttgttaataattgatcaaaatcagccatcgtcccgaattctggattaatatcgtaataatcactaatatcatagccattatcgacaccgggtgaacggtaaattgggttgagccaaatcacatccgcgccgagctgtttaatataatctaaccgttgtgtaattccctggcaaatcaccgattccatcaccatttgaatcctgaaacgaccgtggataaacctgataaacaaccgctgattgccaccattgattagccatatatgattatcccctaaaaagtttgctttaaaaaacttgtcacggtcaaccataaaaggcaccgcttacaacactaaccattctaccattgtcggtcatttgagcgtccccacttatcgctatttatttgttagcctaacacgtttctagccatatcttagttgacgaatcaaaaacgccatgctattatcgcttatattcaaataacgaacgataatcttactttcaagtagcgaattaactgtgcgtcaggaagtcggtgggtgctgcgaaccgatcaggttaatctcgatgaaatacggtaggagaggtccgggtacgcccggcggataacaactagagccgttaactgctagtgagtggagtcatattgtggctcaagctgggtggtaccacggtctaatcatcaaatcgtccctgttgcataataatgcaacagggacgattttttatattcaccactattatcggcgtacaaccgctgttgaagcagtccgtgtcgggctattcactgctggtttaacgacctcaaaggagttaattattatgcctaattcaaagaaatggcgttcagttcagttaccagaagccctactcgttttactcattatgcttgcaattatgggacttggcgttattaagttcggcctgtcaccacagacccccgttattctcgttatcgccctcatcattttatgggcccgaattcgcggtgcccactgggatgacattcatggtggcatcatcgatggtattaaaactgggattatcccaatttttatttttctactcatcggggcactcatcagcgtttggattgcagctggcatcattccttcaatgatggtctttgggtttcatctgatctctgcgcagtggttcgttccatccgtttttctcgtttgtgcaaaattattggaacttccatcgggagtgccttcacgattatctcaacgattgggattgccctctttggaatcgggacaacgatgggcatcaacccagctttgattgccggagctatcatctcaggagccatttttggagataagacttcaccgttgtcagattcgaccaacctggccgcagccattgccgaagcagatttattcgaccacattcgtaatctgatgtggtctacgattcccgcttttgtcttatcactagtactctacgccgttttaggtgccggagccgcaacacaaagccatttgggcaagattcaaacgacgttgaccgtcctcaataataactttaccatcagctggtgggcggccttgccactcgtcgtcatgtttgcctgtgccctacttaaaattccagccattgcaaccttgttgatgaatatcggtcttgccatcgtcatgatttttatcgagcaacctcatattgccttaactaagatcgccaccccgatgatcgaaaccggctttgtagccaaaactggcaacgccggggtggacgccttactctcacgtggcggtatcagtgccatgatgagcacggtctccttaatcctattaaccctgtcgttaggcggtttactaatgaaattcaacctcattcagacagcaatggtgccgctaactaagcgattgaaaggtgccggggcaactgttacggctgcgattttagcgggaatcggtgtcaacatctttgtcggtgaacagtacctttccgttatcttgcctggtaaagcgttcaaaacgaccttcaatcagcgaggattggctaacttagccctcagtcgagtccttgaagacggtggaactgtcatcaattacctgattccgtggggcgttgccggggcctttgccgctaacacgctcggggtatcaaccttagcttacccgccattttctttcttcagcttactatcaccggtattctcaattatcagtggtttcactggcttggggcctgaagcatcagccagccaacgaagccggttaatttaaaactaggttgtttaatttaatcggtgaccgaaccaatcccggaatataattgttactgcttgtgattcgcccccactgctggctacaattagacaagagcatgttttggatcaatctaacaattcgtcaattgatactgcatgatttatttactaataagtcacatcccggcaccacgtcaactaacgaacttagatatgaggagggggattacaatgcttgcatacgggtatcaaaaatttgggggacctaccgtatttgaagaactaccacaatcacagctgattccaacagataatcaattattaatcaaaactttagccgttaacctaaccgaggaagaccgcttagaacggctaggtactatccaaagcgtcgcactaccgcatattcctgggcatgatgtcattgggaaaatcattcaagttggcgccgctgtcactgacttggacgttgggacagtggtggctgcccgcacgaaccatacttacgcggaccaggtttgtttagatagtgatctagcggtgaccatgccaactaatcttgatccggtcaccgccgtcagcttagtcactccagggattgtcgcttacaaaacggtgcgctactttgcggacatccaggccgaccaaacggtgattgtcaaaggcgctggcagcccagtcggcttgttaattattcagttagccaaacgattaggtgcccacgttatcgcgattgctagtgaccgttatgctaaattgattgcgacactgggagtcgaccaattcgtcgactatcagcatcaaaatccagttcacgtgttagccgaccgcggtgacgtcgtaatcaatgtcgctatcgatggcgttggtggcaaagatgacttagcaatggccaaatttgatgcgaccatcgcttcatttgcccgtcacttgccagccaccagtaaatcaattcgtttccaagcaatttccttccaaccgaccgaagtgatttctgatcaagccgccttacaattactattcaagttgctagatactggtcaattgaccacgacgatcgatgaacaactaccgtttaacctcacgggcttcattcaaggtcaccaacgactagatgagcctcacgtgggtcaagtggtcgtcgtgcgctaaaaaaactgctttcaaaagttatccttttgaaagcagtttttagtcaggtggtcgcttattaagaccatcgcagaattttgagcaacccaattcacactaatcgtaacgattgggtatatttcaaagaccgcctcaattagccaagtcctggatacctatgcgagttggtagacccaagcctcataaggccgtaatttatttggctgctgctcgccataattactaatcaagcatttggccgtgggcgtcagatattgatccagtggtcgggacagtgtctcggctgtgaaattgcaacaaactagccaggtccgcccttctccattgccgtgcatataagaaacaccgcggatcatcagcccacaagagctcaaacgaacctaacgtcactaaggggtattgatgtcgtaattgaatcaagtgctggtaatagtaccacactgaatccggatcagccaaagctgcggtagcattgatttggcgatagttgggattgaccgtgagccatggcgccgcgtcactaaaacccgcgttaacctccgtgtcccattgcatcggcgttcgcgagttgtcccgagaacgcgccgctaatcgggccatcatatctgccggtgatagcagctggcgctcagtcactaaatcacgataggcattgagcgattcaatatctcggtaactggctagttcagtaaaatgagcgtcagtcatccccagttcctcaccttgataaatatacggggttcccgcaagaggtgtaaacacgttgcgagcattttagccgaacgtacccgatatgctggtcggtcatcaccaaaacgttgagaccgctcgtggcgtatcatgattgttccaaaacaggctgttccaagcccgcccttcaagtccgacttgccagtcactaatgactttctttagcgccactaacggtgtcttacgcgtactccacttaccaagaccatgctgactattatcaagtcgcagatgttgaaattcaaaaaccatatctaattcgtgccgatcagcgcccgcatacttcagcgcatccgctggtgtcaccccgtgggtctcaccaaccgtcatgatatcaaactgtgacaacacttcttggttcatttcttgcaagaattcatgaactcgcggtccgttcgttactcgagcatcgccaaactgactgggcggtttcagtggaccatttggtaacccgggtaacttagagatttggttaatgacgtccattcgaaaaccgtcaacacccttgttcagccaccaggtcatcatcgtataaactgactctcgtaaggtcggattctcccagtttaaaatcaggttgttttgttgaaaacgtgtgtaaataatactgctgggtctgctcatcatattgccatgctgaaccaccaaaagccgcatcccaattattgggcgcctttttgccgttacctgagcgccaaaagtagaaatcacgatattgattggtgcggtcctggcgactgcgtttgaaccatggatgctcatcagaggtatggttaacaaccaagtccatgatgatctttaagccccggtcatgggcggcttgcaataattcatcaaaatcagccatagtgccaaagtcggccgcaatttgttgataatcactaatatcataaccattatcatcgttgggtgaacgataaatgggattgagccaaatgacgtcgattcctaattgctttaagtagtctaggtgggccgtgatcccctttaagtcaccaataccatcatgattggtatcttgaaaactccgtggatagacctgatagataacggcttgttgccaccacttgattgttgctgccataattacgattaactccttagttacgcggtaaggcccttgatgagcttaactggtaacgtatattttgattccagtgtacaattcgcatcctcaatccgctgcaatagtagagaaaccagtaacgtgctaatatccgctaacggttgttctactgttgttaattcagaatgataatcacgtatgagcgccgtgccatcataaccaacaacgcgtaattgctcaggaaccgttaatgacagttgtcgcgcgacgttgagcactagtaaagcggtcaaatcatcactacaaaaaataccatcatactgatgttgtgtcataatcgtcttaatttccatcatcttcagcgcgggggtcaattcaaacggtaattcatggacatggggtgttagctgttgggcagtcaagtaggcttcatatccttcacggcgaccattcgttggcgaaccagcgtgtgacttaccagtaaaaatagccacgttagtcgctcccccgcctgatgcaatgtctgggttgctagccagccccctggtaattatccgaactaacgatgggaatattgtcggataagtaccggtcaaatgaaataatcggaaggccgtattgttgatattcttcaatacctaaattgtgggcaccagcaataatcccatcgacctgattagccatcaacatttgtaggtagtcgcgttctttttgcggatcatccgcactattacataaaatcaccttataatttttagcaaataagattttttcaatccgggacaccagttcaccaaagaacggattactaatatctgaaaagatgacaccaattaagcgcgtattctttccttgcagtgagcgtgccatattattcggctgataatgcagttctcgcatcgccgcgaaaactttttctttagtctgactactcaggtagccatggttattaataacccgagaaacggttgtcgctgagacccccgctagcttcgcaacatcattttaattttggtttcattgttatcgactccagtatgctctgattggcgccattcccagactttaccggtaactgccgtagtgtcaccttgaacgttaaggcgactcggggtagcgtttaagaagaaacggccggtcatcacggaatagccattatcaatatagcattcaaagactgacacatctatgattagccggatttttatcgtcttatgggccggtaactccacttgacgggtctgaccataatcttcagcaaacgaatttcccgtatgccgccgatcaatcatgacctgaccatggttggcatcaacagtcacccgcagctggccactttcccgctgatcagcaatgttaaccgtgaccgttttatcagcgggaaccgtcagtaagagttcaaagctgccattcaaagcggccaccgtcgcccgttgttgctcaaagactaggtcatgcgccgtcgtccgcaaatcatccaccgctgccactggattttgatagaggtgcccatctttaagcgttagttccttaactaagctcaaacaatgggcccaattttcacaatcagttggataggaaatttcaggtaacccaatccagctgacggctaacgcgcggccatccggcgcattgattgctgcgtggcatacacgtcaaagccgtcatccaattgcgtcagggcgtggggttcagtgaattgtgcctgagccagatccaattgatcggcaactaggtacatgttcggataaatattctgatacggggtcgttgtttgtgataacccttggggacagaacaataagacgggctgttgatcgatccagaccagatttggacactcaatcatataaccccgcgcatttgcgggaacgttcaactcgccttgacacgtccaggtggtcagatcctttgagaaataaaccaagatagcaccgatctcagtagtcgtctgcgcaccgatcagcgcgtagtagccgtggtcagtccggatcaagtctcggatcacgaaacgaactcgtgtacccagccggagcatgcgcaattagtggccgggacagctttttaatgtgattatccgtgtccatccaggcacctaattgatacgattcacgttgccagtcggcagtacggacattacccgtatacataataaataactgatcatcaattggtagtgctgtacccgtgtacgcgccgtgtgagtcgtacggcgtatctggtcgaatcgctaagccctcatcatgccaatccaccaagttcttagaggtcacgtgttgccatgacttcagtccgtgtaccggaccgaacggaaagacttggtagaacaggtgccactgaccatcaaagtatgaaaagccattggggtcatttaacaaacctgatgtaggctgaatatgatgttgcatccgccacttagactggcgtgcctgggcaacgagctgtggtagcttagttgctggccactgttcataaggggtataacgggttttacgattccatatcatgatgataagctcctttttaacgttcgacttaattgtcactattataaaaccgcttacacctatatgtcaatcgtttgacatttttatattatattttcatgtcagcgtttcaaattcggctttttaacaagattatcaagcaattcaattttgtatcaaacgcttgacatattttccaaacttgttattattgggtctgtaaagcgcttgcgttattaaattaaaaataattttagactcagggagtgaattattatgaatcatcaagaagttgccgaccgcgtacttaatgcaattggtaaaaacaacattcaagccgccgcccactgtgcgacacgcctccgtttggtcatcaaggatgaatccaagattgatcaacaagccttagatgacgacgcggacgttaaggggacctttgaaactaacggccaataccaaatcattattggccctggcgatgtcgataaagtctatgacgccttaatcgccaaaaaacaggtcttaaagaagcgacccccgatgacatcaaggcagttgccgctgcgggtcaaaagaaaaatccattaatggacttcctcaaagtcttatctgatatttttattccaatcgtccccgcactagttgctgggggtctattaatggcactaaacaacgttttgactgccgagcatctttttatggcgaagtcagttgttgaagtttaccctggcctcaaaggtatcgccgaaatgattaacgcgatggctagtgcgccgtttactttcttgccaatcctcttaggattttcagcaacgaagcgcttcggtggcaacccctatctgggtgctacgatgggcatgatcatggtcttaccatcactagttaacggctatagcgttgcaacgaccatggctgccggcaagatggtttactggaacgtctttggtttacacgttgcacaagcaggctatcaaggccaagtgctccctgttttggccgttgcttatattttggctactttggagaagttcttccacaaacatatcaagggtgcatttgactttacgttcacgccaatgtttgcaattgtcatcactggctttctaactttcacaatcgtcggtcctgtcttacgaacggtgagcgacgcattaactaacggtttagtaggcttatataacacgactggttggattggcatgggcatttttggccttctctactcggccattgtcattactgggctccaccaaaccttcccggctattgaaacccagttattggctaacgtcgccaaaacgggaggttcttttatcttcccagtcgcctcgatgcccaacattgggcaaggtgccgccactttagctattttctttgccactaagagccaaaagcaaaaagccctgacttcctcagccggggtctcagcgttactcggaattacggaaccgctattttcggggtcaacctcaagatgaaatttccatttgtctttgcagcgattgcctcagtggaattgcttcagctttcttaggactattccacgttctgtccgtggcgatgggtcccgcatcagtcatcgggttcatttcgattgcttcaaagtcgattccagcattcatgctcagtgctgtcatctcgttcgtcgtcgcatttattccaacttttatctatgccaaacgaacactcggtgacgatcgtgatcaagtaaaatcaccagcaccaacgagtaccgtcatcaatgttaatgatgagattatcagtgcaccagtaacggggactagcgaaagtctcaaacaagttaacgaccaagttttctcagccgaaatcatgggtaaaggcgccgcaatcgtgccaagcgctgatcaggtcgtcgcaccagctgacggggtcatcactgtcacttatgatagccatcatgcttatggcatcaaaacaactgctggtgccgaaattctgattcacttaggattagatacggtcaatttaaatggtgaacacttcactactactaacgttcagaagggcgataccgttcatcaaggtgatctacttggaacgtttgacgtcgctgccttaaaagccgctaactatgatccaaccgtcatgctagtcgtcacaaatacggccaattacgctaatgttgaacgactcaaagtcacgaatgtccaagctggtgaacagctcgttgcgctgactgaaccggcagctagctcagttgctgctacaactgtctaaactttattaggaggacgtcatgcctgttgaatatgaccccaaaaccggcttaatcaatcttcataatgaccaaattagctatgttattcaaattttagcccatcgttacccagtgcatcgatattttggacgttacttttcaaaacaaccgtactttgagccgatgccatccagtagccatgcttttgctaatgacccaacagaacgctttccatattccgtgacttcactgccactcgaatattccactattggcagtggtgactatcgccacagccagcttacgttattaaggatgctaacaatcaattactgccaattttagaatataccggtttttctgtgaatgatcagccaatcaactcgcgccaattgccacccaccgttagcaaacacacgcctgtaacaaccctagtcattcatttggccgattcagtgaccaagttacagatggatcttaactacactatttttgaaaatcagccgcttatcttgcgaagcacaactctgcgccatcacggcactactaatttgcaagtaacagccctatccagcgctcaactagatctaccaactgaccaatatactgcgctgacattaagcggtacccatgcacatgaagctaatccatcgtttaaccgtttacacccagggttacaaacggttcgcagtctgcgcggcactagtggaccacaacaccaaccgttcatggctctagcagaacctaacacgacagaattagctgggactgttattggttgtgcactagcatgggagtggtaacttcgacagtactgtcgaagttgaccaatatcaacatagccgcctaacaatcggtcttgaaccagatacattcgaatggcagctcaaaccaaatagcagttttcagactcctgaagccgtgctaacttggacaaatactggttttaacggcatgtcacaagtatttcacgactttagccatcagctgatgccctcccagactaacattccaagtgtgcttaacacttgggaaacactgacatttgccgtttcagagtctaaagttcaacacttaatcgaacacgcccaccagttaggcttacaaatgcttgtcttagacgacggctggtttgtcaaccgtaacagtgaaaatgggcaattaggtgactggtatgttgaccccattaagtttcctaatggtctgaaaccccttgcccaacaagcccatcatcatcgaatgaaattcggtctctgggtggaaccagaaatgatcaccactaacagccagcttttaaccaacaacatcctgactgggtattacaatatgttgatcggacacccatcacagctcgccaccagctagtcttagatctttcaggctgctgtccgtgaccacttagtcactactctgacgaacttggttcaaaataaccaactcgattattttaaatgggatatgaatcgccatcttacacaggttggcagcacacgcttaccggctgcacaacaggggaactgtattatcgctacgtctgtggactttatgatattctcacacgcttgaagcgcgcccgccccaagctgattatcgaaaattgttcagctggtggtggccggtttgattttggtatgctaccatacaccaatcagacgtggataagcgatttgactgatccagtcgaccgagcaaccatcgagaacggatttagttatctatttccaccacggatattcagcaaccatataaccgcatcacccaatgcgcaaaatggccgaataacaccatttgaaaactcgattacaattagctttgcatcgggcaactaggattggaacttaatcctaaacaacttgctcctagtgaacagcaacttcttcgaggagccttgattaaatatcagcaactgaaatctacttttatcaaggcccacttttatcgtctaccgacaacaagacacgttgttgcgtggttgttagtaacggcagataaaaagcaggcaatttgctgttacttaaatgggcttaattctgctgtcaaaactcagcacccattaccattacactatctcgatgctgaattaacttatagcgattcatcaggtaatagctatacggggcatcagttaaacacgatgggaattccacttaaacccaccaacgctgatttcactagtcagctaatttatttacgtcaaagttaatgtaatcgttaacaaaatttctaattaagagtatactattaataaataagactacatttttaactacaggaggcacactatgcttttaggtgtgccaattgaagctggtggtacaaaatttgtttgtgccacgggcgctgaaaacgggcaagttagcgaccgaatttcgatccccacgacaacccccgctgaaaccatgactgcggtagacgactattttacgactcatcccgttgacgcgattggtatcggttcatttggccccatcggcgttaatcccgatgatccgaaatatggttacattaccacgactcccaaacccggctggggtgacttcgatttttaggccatcttaaaagtcgcttcaacatcccactctactggaccactgatgttaacgaagccgcttatggcgaatcaatgattggaatcgctaaggacgtccctaacagcatctacatgacgattggtaccggtgttggcgctggcgtcattagtcagaaccacatttttaatggtcgcactcatactgaacttggtcacatgcgactcaaccggttacctggggacgatttcaagtccaactgccctactaccatgacatctgtttagaaggtttagctgctgggccagcagtgggaaaacgaacggggaaagctgggaaagatattcccgtcgacgatccggtctggccaatcatcgctgactacatcgcacaggcatgtgtcaacctcaccgtcgccttcgcacctgataaaattattcttaacggtggtgttatgaatcaacggcagctctttcccatgattcgtgaaaagtttgccgcctatctaaatggctacgaagaagtcccaccactggatgactatatcgttcccgctggactgggtaacaattctggcattgccggtggcctattgttagctcaggctgctttaaagaacgcttaacaccttgcaaaagagtccgccgatacgcgtttaaacgtatcagcggacttttagtttacagtcaatttgtcattcggttaatgaatatatacggttaaaacagtgataaatccaaaaatcaccccgggaacatttgaaataataacacgggccaatccttataagtcttgaaccagccgtaaccagtccatagtatcccattaatcattgccacgagtggttgtagcggcgatactgggtcacctgagaaattcgaaataatttgtggaatatacgacacgtacatcgcaatacacgtaaatgtcgctaacttactaatcaatttcagatatttaactcgcttgggatccacagcgtccttaccactgggatattcaccattatcaactttatacttaataaataatcaccttcctagctagttattatactacataccactcatcacgcaaaaattcgcgttcgttaaattgtatcggcaccgcaacaatcctcaactattcgcacgttgcgcgcaagttgaaacccagcattccccttacatcaaaattgattgaccctatcaattagtttaatttgtggaagaattcccttaatttagctatactcatctgtcactgaaaccgatatcatacataccagcaatatatagatttttgtattttacgcgttgtgctagctaatttgtcatgagtcatgattaaagtaggcaaaataattaacgtcaaaagcagtcagcttaggctcgctggaaagagttcgggttagcgtaaacatgcttagttcaccctacaccgacctccaggcatttctgccaattgccagagcgcggtagtcaaaaatctaagtcgaggccacgttttaattacgattcatgcaatcagcgctcacataacgcggatatgtcaattttgcttagttcacaggaggatatcgctatgagacatggacaatatcgctacattgttggcacactagctttgataacgactgctgtaggtttagtagcttgttcgaaacagtcagctaatcagcagatcagttaccgtcaaacggctgaggccacccttgataaggggatggataatcaacccgaagcaccgtactggtttccaaaacaactgctgaaatggcagttgagcaaggataaagcagccaagtacaacaccgcctcggttccactagccaaacggatcgataaatggcaactgccgacggttaacaagacccaggacccaaagatgaaggtcgtcgcgttatccattatgaatagttcaactagtggcaacgcgcctcgcgggattaatacgttcgatgcgaatgtcttctccaactggcagtatattgaccaactcgtctactggggcggttcggcgggcgaaggtttgattgtgccaccgaccgcagatgtcatcgattctgctcataaaaacggcgtgcccgttattggaaccgttttctttccacgagtggttagtggtgggaagttaaagtggctcaatgacttcttaaaacaagatgctgacggacattttccgatggctgataaactagtcgcggttgcgaaagcttacgggtttgacggctggttcatcaaccaagagaccgaccccgaagttaaaagttttgattcggcttccaccggaaagaccgcaaccagctcaactagtaatgggctgagcaaaaagcacgcccaactaatgcaacagttaatcaaagaatacaaacaaaaggccggctccaagctagacctgatgtggtatgactcgatgacgaagaatggtaaaatggattggcaaaacgcattgaccaaagaaaaccaatcttatctagtcgatgccaatatgaaaccagttgctgactcgatgtttcttaacttctggtggacgaagaagcgtctcgccagtcaagaattactcaaaaagtcacacgaacgcgccgaaaagcttgggattagcccttacaaccctctttgcgggaatcgatgttcaagctgacggaaccgctacccccgttcgttggaatctattcgctaataaacaacatgtgccatacacgtcgctaggattgtacgcaccggactggacacacgcttcttccgatacggttgacgaatttcaagccaaagaaggtgctctgtgggtcaatgatcaaaatgatccgtcccgtagcattccgtcaactacttcaacacattggccgggtgtttcaacatacgcggttgaacaaagtgccattacgaaacagccctttgtcactaatttcagcttaggcaatggctataactacttcattaaggggaaaaatgtttcgctacgtgattggaacaatcgctcactgcaagcagtcaatccgacttaccgctggttaatcaataatggcaatggtaatgcgttaaaggccagctttgactacactgacgcctacgaaggtggcaatgatatcaagttagccggcaaaatgcgtaaggacaccgctagcacaatcaaactctacaccacggacctagacgtcactgccgatacccaggttagtttaaccgctaaggcatctggtaaatctacagctaaactagtggtgaccttaaaggacggccgcactaagaccatcgcgggtgaccggacactcagcaagcactggacgaccgttagctatgacgttagtcagttaacaaaaaaaaacaatcaaaggccttagcctcaaaatcagtgccgccgagactgatgctagctacagcgttcaattaggtcgcctcgcaattaccggcaagcagcaaaggccgcgccgaaaaggtcaaccaggtcaccattgataatcggaccttcgacgaagaaggcaagtacgctggtgtcaatctgagttggcaagccaccactaaaaataagctggatcattacgaaatttatcaggttaacaatgacggttctcgctcatttctggggccactaacacgactaatttctatttaaacgcgttgaaacggaatgggcagcacaacgagaccaatctgatggtcgttccagttgatatttggaaccaacgtggcgatgcttctgaccaagttaccttaaaatggccggataatcgtaaacctaaagcggcatttacggttaaccgcaccctggcagctcccggtaacacgatcaagtttacaaatgcctcatccaaaaacgcaaccagctataaatgggaatttgacggtgccacaaagacgaccagcaccgccaaaaaccccacggtcacttaccgtaaggctggcacttataacgtcacattaaccgctaaaaataaggatggccaacgacacgttacaatgaaaaagctcattacgattacaccgaaagctcaaggcgctttaaccttactatccaagaacgccaagaccagtgcctccggatacacgaatagtagtgaagcacctaaaatggcggtggatgggaaactcgatactaaatggtgtgcaaccggtaaggcaccgcataccttgacgctggatttaggccgtcaaacgactgtgagtgcggttaaattagcgcatgccaaagctggtggcgaaggtgctgatatgaacacccgcgcttggaccattcaggtcagcactgatggcaaacgctacacggacgttgcccggacctacaataactcacgcaagccactagtctcaatactttcgcggctacttcggcgcgctacgtccggttagtcgtcgataaaccaacccaagttgctgacaccgccgttcggatttacgaaatggacgtgctaggattgacgcaaacactcaaataaccctaccgatgctatttgaatagaacagccgagcccctcacttggaaatcgatatttccaagtgagggactcttttatgtccagacactaaaaaggcccgtatcagctgatacggaccgatttaagttaggttggaatgaattgagctcattcttaggttggaaacttgattgtggccagttacggtcagaccacaatcaagcgttcatatttacttagttgttacggtgctagcgacctcgatagcttgcccattaagttcgatagtcagtggttccccactaaccagttcaacggtcgtaccctgttgatcgacatccactttaatcaagcgaccgcggaagttaacgtggaatatgataatgggtccacgctttaggcacaaacggtgcaaaggctaaggtatcatccttaactcgcataccagcaaagccttgaacgattgcgagccatgaaccggtcatcgacgtaatatgcaagccgtcgaccgtatcattattataattatcaagatcaagacgggctgtccgttcatacatttccacggccttatcctcataatgcaagtccgctgctagaatggcatggacggctggtgaaagactggattcatggacggtcaacggttcatagaaatcaaagttacgtttcttctgttccgccgtgaatttatccatgaagtaatagattccttgcaagacatccgcacgcttgatatacggtgaccgtagaatatgatcccatgaccagtgttgattgattggccgttgatcagcgggaatacttgaaactggcttgacgtccttatcaaggaagccatcttgttgaacgaagattcccaatttttcatcatacgggaagtacatccggtcaacaatatcttgccactttgcaagctcagcatccgtgatttgaagtgctgcacgcttagcggcatccactttcttcaaactcgctaacgtgtattctaacgtccagcgcgccataaagttcgtataccaattgttattcacgttgttttcatactcattaggaccagtgacaccgtgaatcatatactgttgtttccgttctgagaagtggacccgatcagcccaaaaacgtgaaatccccgtcaaaacgtcgattcctttagtcttcaagtaggtctcatcaccggtataacgtgtgtaattgaagatggcatacgcaatagacccatttcgatgaatctcttcgaacgtaatctcccattcgttatggcactcaattccgttgaaggtcaccatcgggtacaaggcaccagccaagccccgcattttagcattatggaaagctccagcaagctgattataccggtattccagtaagttctcccgttacttctggtttcgccaatgaaaggtagaacggtactccgaacgcttcggtatcccaatacgtcgcaccaccatacttttcaccagtaaagccttttggccccaggttcaggcgcttatcttcgccatagtaggtcgagaataactggaataagttgaagcgaatgccttgttgtgccgcatcgtcaccgtcaatcaacacgtcagataactgccagcgtttagcccaaccatcaacatgggcccgccgtaagtcctcatatgactgtgtgctgaccgtttcacttaattcggctaagccagtccgcatcgccgccatatccgcgtaatcccgtgaagtcaccacgaggactcgtttttcaaaattcttggtttcatccggtgctaacgttccccggaagatatttgtaactgccttttcggtttctggggcgttaatacctcgaaaagccgtttcatgaagcatctgcatgccgagcgtaaagcgcggtgttccgagaaagttattcggcttcgtttctgcaaacatgctgccaccagtaatcgcatgactcttgtctagcacttgccagaactgctcatcatagttcgcatcttcattgaagacgtccgcatcaatttgcgaaataaatccaatttggaccggttccgcacccaaattgtgaacactatagtgcacatcaaataactctttttgtgcaacgctgacgaaccgatcaatcatgaattggacgcgtttttcacccttggtaataataaatgaacgccgtaaaattcccgtatgcatatcaagatccaacgtaaagtcactgactgtgtccttcgccaaatcaacttgatcaccatcaatcgtgatattgactttgatgaaattgaccgaattgatcaccttaccgaaataatcgggataaccgttcttccaccagccgacccgggttttatcgggataccagaccccaccgatataaatccctttgagggtatcgttagaatagtgctcttcaaacattccccgcatacccatgtagccgttaccaatactggtcatgctttctcgcaatcgcttatccgtcggtacgagttcatgactaatgacgtgccacggatctacttcaaaaatacgtttcattgttgttgctcctccgtcgttcgaaattaccgaataacatctttagtttcagaatcaaagaagtgggccttcgacatttcaaaagcaacttccacattctcacccgggttatgataatcacgtgcatccacttgggcagtaaatttagatttgccagctgtacaatataacatgctttcggcacctaagaattcagaaacgacgaccttcgtcttaacaattgaatctgacatcgcttcaagcgcaatttgctcagcatgaatgtcctctggtcggatacccacaatcatctttttctggtcatagccttgagcctttaaaactttcaattgaccttccgggacagctacgtcgagtccctcaccatcagttacccgaccatcatgtaaggtggcattgaagaagttcattgaaggtgatcccatgaagccagccacaaattgattaaccggttcgttatacaattcgtgcggtgtcccaacttgcatgatcttaccgtcattcataatgacgatccgatcagccatcgtcatcgcttcaatttgatcatgggtgacatagatcatgttggtcttcaagcgttgatgcatttgagcaatcgtagtccgcatatcgacccgtagcttagcatccaagttagataacggttcgtccaataggaacgtccccgcgtcccggacgatggcccgtcctaaagcaacccgttgccgttgaccaccagataaattggctggtttccgttgtagataatcggttaagcccaattgctcagcagcgttatccactcgctttttgatttcagtattactgtaagttttccgaatcttcaatccaaaggccatattgtcaaagactgacatgttcggggtatagtgcataagtttggaaaaccatcgcgatatcacggtttttggttccacgtcattcataacttgaccgttcatcttgaagtcacccttagtgatgtcttccaagccagcaatcatccgtaatgtcgttgacttaccacagccagatgggccaatgaagaagatgaactccccatctttaatatcaagattcatatcggtaactgaatatttatcgttaccctcatattttttgtaaatgtgatcgagattcatttcaaccatcgaaatccactcccttgttttctcacttctaaactactattacacgtgcaatcgcccgcaaacggttgctttttgatcgattattcaaagctattaatcagctaattggactggtcagcaactttagtcaccgccgtattggtgacatatttaattaatactggttgaccatcaactgtcagcttgccatccacaacttcagtaggaccatctgttaacagattttgatagctaccagctgctagcttagtcgcaactgctgtgacctgaccttttaacggaatccaggctgttaacgcttcgccagccgcacggtaagtaatcttaacgataccttcttctacgactgccaattggtagtccgcagcacgcagtaatggtagttgcttaatagtcactagcttttgaatcagtggtgtcacgtccccatgacgatctgcaaccatggtgtcccgatagaacaatgatggttggtgttcggccaaaaattcttgcccgttatagattaacggaataccacgttgcatgaagatccaggtcaagttattaacggcttcagctttgctgtgcatcaagctcatcatgcgtgcattatcatgattttccaagaagcgcatcttgacataattaccagggaaagtggcatcttggcgttgtaacaagtcaacataccgttcgaccgtactgcgtccttgccagtaatctttaaaatcaccgaagacgtcgtaatccgtatgtcatatcaaaagcttgataaagttcactgtcagacagacccgtgtagccttgtgaccgcagttcctcaataaaaccactgccggctgactccgctaaccataacgtttccgggtacttcgcattaacctgtttccgcgcttcaagccagaaatcaagtggcactaatggcgcaacatcacaacggtaaccgtccacaaactggctccaatacaagagtgtgtcgatttgatactgccacaactcatggtgaccatagtctaagtctttaacgtcactccagtcgccgaccttattcgtcaactgaccatccgcgtcgtgataaaaccactctggatgttcggttgctaagactgaatcaggcgaagtgtgattatagacaatgtctaacatcactttcattcctaattcatgcgccctatccgtgagtgctttaaagtcagctaaagtcccgtattccggattgatcccacggtagtccttgattgcatatggtggccgaaccaagtgtccccttacggttgacctcaccgatcggattgattggcagtagccacaaaatatcggttcctaaatccttaattcgttgtaagtcagcagttacgccagcaaaattaccagcttctgagtagtttctaacaaagactgagtaaatcatctcattgcgtaattgcgtttgcgtatcgcgtgccattaatcttcctcatttctatgcttactaattgacctaaagcaacatggtttggtcaacttccggatctttgaattttgttttcagatatacccacaacacaacgaaggccaagctgagggactgcacggtcaattcgatagtgacatcaaaatgaattaagccaatcaccatcgctaacagactcccaatccccatcatcatcaacgttaagttaacgccttcgcggaaattccgaatatgcgtgatcttattatgtcgtgacaagaataagaagaacgccgccccatttacgaggatcaggttggacccccacaataattaatcccagtgccatgagcataaatagaccaatcatcactttattgctttgataccaagaattaaccagaaacgcatgagcgtttgtctttaagttatggcctggcacatacttggctttaaattcactaccgaccgatttcacttgaaacgtactagcatgtaaattaatgacattcttgcgtcccgccatatcatcgttcgtgagatcgaagctgcgcaacattatccttagttttaataatgatttgatgtttgacatccttgaaccgctgatcacggtagttcgcagttttcattgccgtttgcatctgatcactgaccatcattttatcaatgtgtggtaaaaatggtgacagattaaaattcgtttggtgattatagtaaaacggaatcggcatgaccattaccgcggtcaaaaagataaataaaacaataatctgtaaccaattaaactgatcacggttggcaaacattcttcgaggtgagaagaggctgccaaaaaaccggaccggaaaggcggttgttttgtttttcgtactctgcatctaatttcacccctactaatatttgagttaacccttgctgccaccagcgagcaatcctgaaacgaagaaccgctgtaagtagaagaacaaggcagcaattggtaacgcgactaagattgcccccgctgagaagagcacaacttgttgattttgagcgttattaatgaatgtctggagccctacggcaaccgtataatgtgattcagacgtcaataagaacttcgccatcaggtaatcttgaactggtgacatgaaggcccataacgcttgaaccgcaatcattggtttaactaatggtaagacaattgaccagaaaatcttgaaattaccagcaccatccaacttagctgattcatccaaatcatacggaacattgtcaaagtaacctttcatcagccaagtgttctgtgggatcccaccaccaatgtaaattgcgtgggtcaagaaccagtaatggtccaaagcgttcaacatgttagctaagacgtagtaagcagtcaaagcggccatggttggtaccatttgaattacgatgaaaaacgttagactgaactttttaccagcaaaacggtaacgactataaacatagccggctaacgtcacaacgatgacttgaatgaccatacatgagactgaaataatcatggtattcaaataccagctaccatacagggtttgcgtaaataagttcttaaagttaaccaacgtccacttaccaccaaaatcaaggacgaaggcttgcacgttagcatccttaaacgccgtgatgaatgtgatcaaaacgggataaataataataattccgagaatgaccatatacagatacgtaaagaattctttccagaaacggtgccgacgcgcgctattttgctttgaattggcattcttaggtgccactgcttgtgcattatccataacactagtccccatttcaaacgcgtgggtcttcttgaagacaatcaatgagatcccgataactaagacggaaataatcaacgtaacggccgcggccaatgaatactgtggtgacgtccccgttgttaacttgtagatccatgagatcaggatatccgtcccaccggcgttagcaccgacatcaccagggccaccttggttaaacagatagatcatcgagaagttattgaagttaaacgtatactgcgtcacaaagattggcgctgcaatagcaaaaatcgttggcaacgtaatcttgttgaacttttgcattactgtcgcaccatctagcgttgcggcttcgtagagatcttctggaatcgcttgcagtataccagtaatcataacgtaaatgtacgggaatcctaaccaaccttgaatcataataatagcaactttagtccagaacgtatccgtcatccagtggatcggcgcaatgtgagcaaatggaactaacgtattccataagccgatgactgcgcagaacattgatcgcaccagctgaatcattaaaaatgtttgaaaaactcataattgatacaaacgctggaatcgcccaaggaagcaagaaaatcactccgaagaagcgcttacctttgatgaagttttgattagcaattactgcggtggcaatcccaataataatttgtaacgttgttgcacatacggtccaaataacggtccaaccaaaaacagcgttgaaggttgcccggtaactactcaagaagaacattgatgtgaagtttttgaacccaatccaatccaataacatagctggtggaatatgcgcaaaatcatagttcgtaaaagccatcagtagtgtaaccaatactgggaacacaatcgtaaaaaccattaaaatataggccggtgtggttaataaataagcaaagccaccatctactaaactcgcacctaactctttaaacgtatgggagacctttttaccattattaattaactgtgcaacgtgtttcgcatctgtaaaggtttgcaatataaaatacgataaacacaattgtcaatagaatctgcaacgtcccatagatcatcatgaacaaagagttgtcttccattgagactgaacccaatgtgactaaattggcaaatgcgctaaagcccccgaagatgaactcagcaataaatgccaatagaataataatgaagccaacaccttttatggtctgaccgttatacagctgaccgagcccgggaataattgacaggcgttgcgctttctttacatccttgacttgcatgtcgcccgcacccctttcctaaataaattctaaatatcgtgcatttttccttttaaaaaggctgagacaaaacgaattttgtttcagccccttaaattacaattttaattacttatcatacttttgtgagatattagttaagatcgtcttttgcgctttattagcagcttgctttggtgccatcttgccgctagcagcattggtaaccatcgtttgtgctggtgtgttccaaacttctgacatttgtggtaagttgatcaaaggaacatccttgtcgtattgctttgaaacggccgtagccatgtcatcgccagtacttacagcttccttacgagcagctgtgtttgctggaatttcactagcagacttgtaaagcttgttttggttagtcttgttagagatgaagtctaaccaagcttgtgcagcagtcttatgcttagagtagtttgagattgcccaagctttaccaccggcaaacgcttgataatctttgccgttattcaacttaggtaaaacagcaacaccataatcgatattagacttcttgtaagttgcagccatccaagggccatcaataacagcagcagtcttattagacgtaaattgtgaggtcacaaagttttcgttagaagtgacattttgcatcccacttggccagtacttcgtaaaccacttcgtcatgtaagttaaaccttcaacggcgccagaattgttcaagcccatcttcttggcgttcgtattgccatcagcaaagacgtaaccaccataacctttgatgacaccaaaggcattgtagaagtttgtccattgagtcaagaaggcaactgacttagtcttatcattagcgtaagcatacttcttgtcagaagctaacttttcaagttccttgaagttcttaggtgcagtcttgattagcttcttgttgtagtacagaacgtcagattcgatcgttacaggcgctgcataaaccttattcttataagtaacagatttcttccccgttgcgttgtaacgaccactggtcaacttgactgttgatagttgaccttgtgacgccatttgaccaacccggtcgtatggtgccattaaaacatcaggacccttgccggaaggaccatccagcttcaaagcatcgtcttcatcaagcatggccttgtatgaaaccttaaccttaacgttgtacttcttttcaaactttggaatcaccgatttcatgtatgatcttatatgaaggatccgctgaaacctttaacgtcttgtccatctttgaactactagatgaagatttactattaccacaacctacgagcgtgagtgctaaaccagtggctaggacacccatccccaactttttccaagtactcatagtgcttcctccttgcgaagtatcttaattcatttaccataatttattatgcaactgtgcaaacgctttcgcaagcgttttcgtaatgttaacgttaacagaatcataccaaaaataaatcctaacgcttaaaaacgttaggatttattggtccatcaacctttataccaatttatataaagattgataagttaattaaaatacatcacatgatttatatataccaattttaggataatcatgcactcacattgcttatgccgatttaacgactaagctactccaagctggtaacgtcacttggcgtcccctatatgttgcaccaccctgtacaagcaacactttaccaccaacaaaaacggcaacagatacgtttgcgcttgcgcacttaaattacaaactatcgctgcttgtttttgaccatcatcaatgaggtaggtaaagagttgttcagcacttccgagcataatgaactgaccattagtaaagggtgcgcactgctttagctgcagcaactgttgataatagtgataaatactgtcggggtcagcgatttctgcttgcgcattcatgtcatcagtatcaccatgtttccatggtaagtggtcagagaaaccatgataaaccgtattgtcccattgcatggggccgcgccccgccattttatgagtttgattcaacatccgcatgatttccaccttagacttaccagcggcttgagcgctcgcaacaaaggtgggtaccgtctggtcttcaaagtccgcaatatcatgataacggatatttgttaatcctaattcttccccataataaataatgggaatgccacgctgcaaatacagggccgtcgctaacgccttggcacttgcttgcggataatcaggatcaccgtaacgcgtggcgacccgagccatatcatgattattccagtaaagtgttggtagactggtgtctgctaaagccgcttgaataccgaccgtattttgcttataggccgtcacatccatcggtcggggctgaaatgtgtcggagaagctcggatcatcctgggtattgtcgtccgcaaaagttctgaacgtaatcacttgattacactcatccgtacctggtgtcgtatagtcgaccatcaaatgggggtcagcggatgacgcttcaccgacgacgtacgtatccgggtgcttagctttgattgcggcgacaaagtcgtgtaagtactgatgcactttcggtaagtgggcataaaacatatcgctaatgatgggtgtcgaatcaccagtccgatttggataagtttggcgaaaatctgctttagccagatgaataaacgcatctaaccggagaccatcaatcccctcgttttcaacccaaaactcagcaacatcacgcatcacctgttgcactgccggattcttccaattgaggtccggcatccgtttatcaaacaagtggaaataatactgtgagccgccgccggatccttcgcccaaacactgccaccgaaaaacgaaccccagttgtttgggcgcccaccatcggctgcgggatcttgccataagtagtagtcccgatacttactctgtggatcagcgagagcttgcttgaaccatggatgctgatctgaagtatgattcaagacaaagtcaaagataagatacatgccgtgctcatgaactgttttaatgagcgtctcaacgtccatcatggttcctaagctcgaatcaacttggtagtaatccgaaacatcgtagccattatcaacctggggtgactgataaattgggtttaaccatatcgtggtaatcccaagttgcttcaaatagggaatcttcgcggtaattcccggaatatcaccaatgccatcgtgattactatcgttaaaactcttaggatatatttgataaatcgtttgttgatcataccaatgcttgctcatctatccagactcctctttaacgggtcgattcagccaccgacaaccgtgaattaatgatgatttttcttgatcatgccgcccgcgagaacgatcagtatggttgatattagccaataatagccgtgcagcagctcgtcccattgcttcaagcggttgcttcatcgttgtcaaccgtttggctgcaatctgatttaataacacgccatcaaaaccgataatgccatattctatgggaacgcgaccaccttgattaataattgccgtttcaacgccgatcgccaaccgatcacttgcacaaataaacgccgtattacgtggaaaaccagaccaatggctcttcacatacgcagttgcaacgtgtgaatgattggctaatcgaataatctgagcgctaatatgatgtgtcgtgacgtactctcgaaaaacctcgttcacgatctagctcaaacggttcggcaatagcgataccaataaagacaagatgcgtatagccctgttccgcggcataacgtgtactttcccagaccgcctgataattattagtatcaacgtagtcgtatccctgacgattgctaccaacaaagacgactggctgattaagacgttcgacccatgcgtaatcggcttgccgaataccagtcaaaatatagccatcacattcgccaacctcatagctattgcgcgtcgcaatctgcaaggcgtattgatgttgattcaattcattcgcaatccccgcgagcaacatcatgtaatagggttccgtcgtgtccatgtcttcaaaaatcgttaattttacaacccgggttctccgccctactagcgctcgcgctgccgcattcggatgatagtctagctgtgtcatcacatttaaaatcatctctcgaagctcaggacgaacctgttccggatgattaatgactcgtggaaactgtcatttttgagacattagctttttcgcgacatcgtttagcgttatcataatcaaaataccccctaacttactactgtaaggacttgatttggtggacggaatggcgtttaacaatttgatgaggcacaattactgccgttgataattcatcagcgggatggtcagccatcgcaatcttggccgcttcttcacctaaacgctgtggaaagaccgcaatcgatgtcagcatcgggtgcgctaaatcagaaaaaaatggagttattaaaaccaatcagtgagaattgtttaactttccagttcggatcattatggagaacctgttgtaatttcaacgccaacatatcatctacggccacaaacccggtaacatctggatactgttcaaaaaacttatgtagtgttttaacacccgccgcatgagtctcaaaccgttcttccaacataatatttggtaactgattttgcatcattacacgttgatagccaagcatccgaatcactttgcaccatccgtgataaatccgaatacaaaaacccaatgcgccggtgtccatgatcaattagatattgggctgcatccgttccggcttggatattatcattatcaacatacgatgttttattgacgtcttggtaaggtttaccaatcacaacgtattggacatcaaattgcttcaagcgctcaacaactgggtcatttttttcagaatacagtaaaataaaagttttgatatggccttgtgcaatcatgacatcaatattatgcaccagttcatcacttgaaatccccgttgctagcgttgtcattgcgccattcttactacaaacttcattgataccccgaatcatctctaagaaaaatgggttagaaaagatttcgtgatgatctactggtagtaccaccccgattgtattactagccttagttgctaaattctgcgcattaaaatccggcgcgtaatttaactcccgcgccgctttaatgaccttgtcacacgtgttggcttactgataatcttgctaccatgcattgcacgtgacgctgttgaaggcgaaacacacgcgcgctgggcaacatctttgatcgttgccatcatgatcccccgatctatttgaatccatctcattaaatataaaacgttttcatcgttattgcaagcgattgcataaacttgcattatttatttaattatactttataacaaaaaactgtgcccaacaaaatcggcacagttgtgagtatttaactaataattgtttccagaccagctgccaaaataccaccaagcaatggaccaaacattggaacccaggcataaccccaattagccaaccctttattaggaaccgggagaatcgtgtaggctaatcgtggtgcccaatcacgcgccggattaatcgcaaagcctgtggttccacccaaggtctgaccaacgacaacaatgagcagccccaccatcaatggctttaatccctgggtaaagttaccgagattcaacaacacgaagataaagaagaaggtcgcaatcgtttcgcttagaaaattaaataccgggttactgatggctggaccagttgcaaaaatgccaacttgattgccatctgccgccgttttggcagcttgaaagtgtgggtagtactgaataataacgattaccgcgccgataaaggcccctaagaactggcctaataagtacggccaaacgttagccattggcaaataaccgaataacgcaaaaccaactgtcaccgctggatttagatgaccatccgaaccaaattgtccggcaacatagaccccaaacgtaacggctaggccccacgccaagcaaataaacgtccaattctgatggcgtgcataattaccctttaaattcatggcggcaccactaccaaccccaaatacaattaacaccatggtacctaaaaattcacctaaaaaaccgtgcatgtttcgtcaccatcctacttgatttttaatggcgctaatttggagcttcgacatccgcaagtggcacagccgcctgtaatagcgatgcggccgtgtaggcactctcaatgagtgccgtatcatataaatggaccgttttatcactcatttcaatggccatttccagattcattttggcactaccaagatcataaaaggccaagagttcatccgcatgatttgcatcaaacgcttgtgtaattttggtcaggctggttccgacttgattgtcatccgtaccaccagcaatcgtaatcgaaacgtcctgggcaacttgccctaacaaacgctgaataccgcggcaatttctgggacgtgtgaaacaactacaattcctaaactcataagattccctccgtatccagtaacgttgtaaataaataaccactcgagacagcacctggatcaaggtgtcccactgaacgttcacctagataggatgctcgccctttttagccaccatcggttcggtgctagcaactgcatcatcgataacatcctcgcgtcaattcgcccgcttggaccgcctgaacaaccggtgcccacacatcaatcagcgtcttatcgccggttgtcgcgccaccccgcttttcaatcccagctaatgcagcggccaacaatccacctaaatcgctatcaatcttactttgctttgccatttctaagaaagctgttccgtacaatggtccagaagcaccaccgactttgctaatcaatgccatcgccgttgcttgaaatagtttagttatgtctgctggttgcgtggcaagtgctgccttaactgccgctaggccccgagccatattacccccgtggtcaccatcgccaatcggcgtatctaattcacttaggtaactttggtgttgttcaatctgatcagcaaacttattcagccatactgttgtgttctcaactgttaacattctcaattcctccttatgaccacgcgattgttttgaccgggtactgtaagtaatctagccattgagattcagcaacatcgaatatcgtcagtgaaataccggccatatcaatcgaagtcatataattaccaaccttcataaaggccggttgaatgtgccgtgttgccagttcatccaacaagtcatggcaaaagacatactgatccatcaatggcgtcgctcccataccattaaccaagaacgcatactgatgatctgactgtaggtgtaattcatcatctaatttacctagcaattcctgaacaagttgtttggatggcttgatttttcgcgccgataacctggttcgctatggattccgacgccaaactcgatttcatcatctgccaattcaaagccaggtttgccgacttccggcaccgtcgctgcggataatgcgaccgcaatcgttttaatccgtggtaaaacatgcgttgctaaactttctaaatcatccaaatcagcgccttgatccgcggccgccccaagtatcttatgcataaagatagtgccggcaaccccgcgacgaccctgagaatatataaactatccttaacagcaatgtcatcatcaacgacaatcgatttaacttgaatatcatctaattcagccatatctttcgccatatcgaaattcatgacatcaccagaataattcttcacgactaagaaaacgcccttaccttgatcgacagccttaattgccgcataaatttggtctggcgtcggtgaggtgaaaacctgtcctgccacggcagcgctgagcatgccagggccaacaaagccggcgtgggcgggctcatgaccactcccgccaccactaacaattccaacttttccccgcattgaatcttgatcactacgaaccattgcttcggtatccggtaatttagttaaatactgaggataggcacgtactaacccatcaaccatttcgtcgacgacattcttgggatcattaattatttttttcatttttgttgtccttcctttctcgaattaacacgttaattgtaaatgaatccgctttcaaaaataataatggacagtttcgttattttgtccgccagcttctgacaagcatggtcattcgaatgcgttataataaaatcaaattaacaatataagaaggtgttcccatgcaaatcattaatgaacctcaaaatgccctgagtcaagcaactcagggcattcaatgggcctatccaaatttaacatgggtaccaaatacattcggatgttacgacagcaactttcaagatgatcagattccgttaattgctggtgggggcagcggtcacgatccggcacactggggttatgttgggcctggtatgttaactgccgcaatcatgggaacggtttttcaacccctacatctcaagaaatcgttaaagtcacaaaacaggtgacacgccagcgtcgcgtttttttcattgttaaaaattttccagcagatgttagtgcgtttacggctgctcaacaacaactgcaaaaggaacattggcaaactggtctatgtattgtggcagacgatatttccccgtggatcatgaatctttaaaacagcgccgacgaggagttgctggcacgattttagtgcataaaattcttggtgccgctgcagctcaggggcctctatcgctgaattgacccacatcgctgccgccctagtgccaaacattcacacgattggggttgctgctagcggtgcccgcattccaggacagtcaacggcatcgtttaacttgaatcctggtgaaatttattacggtatcggtattcacggggaacccggttatcggcgtgaaccttttcaatcgtcagaacgactcgcacaggaattaattagtaaattacgtctcaactttaagtggcatgctgacgaccattacgccgttttcgttaactccctcggtgggacaacgcccatggaactcatggtgttcaataatgatgttcacgaattactcaccttagccgcactaacaatcgacttcaacaaagtgggaactttttaactgctaacgggatgcatgggttgtcgtcattaaccttactcagcctagccgaccctgactggttaactgctctaaaccgacccgtcaaaactgctgcttggcctaactagttcaaaatttcgagtgtcatttcgatggccgcaatagcgtgctgagaaagcacctcataatcttcaggatgattcgcaacgatattatgcgttaacgattgtgcgattcccaagcacagcaaccagattagggccgccgtttctgttgtattggcgtgcgttagttcagtcaataacgtggctaagtggttaccgacaagtgccgtcacgtcaatttcatgctgcgtgttaatacattctgcataaaattgacgattcgcatctaactcgtaacaaactagtttaataatgtcgatccaaggcaaataattcagattatgttcaaccgtttcagtcagggtgtcatcaataaaccaggttaataattcatatttatcttgaaaataatcataaaatgtttgccgtctaaaatcggcggtgctcataattgccgtcacggaagttcggctaaagcccctcactaggacgacgtcatgaaaggcttgtgcaatttttcttttttgtaatgtatgccattcaaacgcctccatactgccttttatcaacattgtagcgataactgcaacccatgtccaacgggagccatattccggattaattgatcactaggagaaacgctacataacgtcatagcgtttctcctagcgatatttttatattacttataaccaataatttcaggtctagtaattctcaacaaattcccctaaaatacattcaacacacttaggggcttcaattattatgacatcatcactcacggttcggcgtatcccgttactcggtgctttaattgccatgcaacttatcttaggaagtttactgtcaattcaactattgctaaccaagatatccttcgcgtttattattattggtttaacggcccgtttattttcaccactagttacagccggcaggtagcgcgatttcctccctactcggaatgctgctcttcccaaagttcacctttttttcctggttttatcctaaccgcttttctgaccgggttagtctttggatacgcctttcaacatcaaacttcactgacacgcgttctcgtcgctaactttatcgtcgtctttattctcaatttgtttctaaacagcctctggcttcatctcatgtacttaacaccatggtccgttttgctaacaacgcgcatgatacaagaagtcataacctacgtctgctactcagttatcttgattgccctatttaagattccgattctgaaccagctcaccgcacgttttaagtgacggtggtcattaattatttcgttaattaagtaatgactggtggtacttaatttaaagctaagtaaaaaaccaagggccacagtacattgctgtgacccttagtttttgtgcaaacaattgattgtcatacgaccccgtcagacctaccaacagtgccgaaactcggcttcgtattaatttaatgctgccaccattccggccaaaaattcagcggcaccgcccacgaaaatttgttgtgaatgcttgaagattggcgcttgttcatccgtattcacagaaagaacgtgttgcgcaccagccatgccagccaagtaatcatcatcaccagcgacgccaatgttgatcaagacttctggcgcaaccgtcactgctgaggcaccaatttgttgctcaatgctaaattgttccatagccgttagcggctgggtaacagccaatgctgcaccaatccacttggccaattgttgggcttgaagcaatactgccgacattgactggcacatccctagtcaaattcaagcgttttacgacccgatgtaggtcggccacgactaggtgctcaggagctgtgtggggtcccgttgtcgggacatcggccacttcgtcattcaggctcgtcgtggcaaaagtcaacgccaattgcgtatccgtgccaacaatcaacggtagtgtcgccacgtcattttgcaaggcacttaacggcgagtgttgcgtataggctagatcaccgatcaatggcatcaaaattttaaacggcgccaaggcattttggctggcaaacattgccgccaattgcgctgcgtctgtaaatgagcgctcatcatcggcctgttgggccgcattgtagacactagtctgtaaggcggccgtaatcgccattgctggcgccaaggcagttaacggcggctgttctgtcagcgctaactgtcgtgcctggtctgtggcatgttgccatattcccgctgtaatcgccccggcaaataattgccccaagctttgcgcccgttgcatcactcgttgtccttgtcccaattgaccgatttgatcagcggccgtaaccgggacatcggtgagttgaacatccgcgatggtcaatccgtgtaaccctaaaggggttattggttggctgaccgtgacgcctggctgatcagcactaataacaaaggcccccgtagcattcggtggtgtctgtgcgagaactaaatactcagttgcctgtgtaacattcaataccgttttaaccgcaccggacagttgccagccagctgttaccggcgttgctttgacggtactactagccatgacttgttccggtaatgccgcgagtccaaaaacacctgattgtgcacaataccgttggcgttgttgcggggttccaaacgttaatattgcatcctcaacttgccaactactggcaaaactcatagcgagcccagctgaactttgcgccagcgctaatgtactcaaaacccgttggctcaggcggtcatctggtagtggatcgtccaaagccaattgctgggcaagcgttgtcagtgtcggtcgatcgactttcccagtcgactccatctgcatggcgagtcccatcaattgctcacgtgccagtgccatcaaccgttgccacaatcccgtctgtcgtgccgttaaatgtaattccgattccgatccctcacttcatccgtcatctattaagtctaacttaccacatttttagccgctaacgaaaaaagcgaataaacattatcactattaaacgctgccgaatccaccggtcgaaaaacagtcgtccggattaaacatccgtcgactgtctaagatacgtattattactgctggtcatctaaatccgccgccataaacccatgttctaaaatccccatgtaggtttttgcgcgactgaccacccattcgatatcggccatcgattcaacttgatgattctcacgcatataggtctgaaattccataaaaatctgattgtaaacacccataatcaaagcaatcgttgcatcacgatcaacatccgcacgcagcgtcattttatccagcacctgactgatcatttcccgggaaatagtcatcgacttagtatacaggatcttcatttgtgcctgtatctttaccggcaagcgctccagcgcgccataggcgtcaatcaagaccttcatttcatccgggtggtctttaccaaacgccgccttgtaacgcgcactccgcaccatcaacgtgactaggtcatctggaacatcaaaaacttgttgattaatggtggcaataatcgtgtcagtagcaagctgaacagtggccaaatacaagcgctgtttgctaccgtaataatgaaataataggcccttagacaccgttgccgcggacgcaatcacatccgttttagcatctcgatagccactgacggcaaaggtgtgcatggccgcgtgcataatacgctcgaccttcgccgggtctttaggaacaggttgttttactgccatgtcacgcactcctttcgtttactgagctagatcacgccgccgataacttagtgctgctactactaatattagcacagttaataataggcaccagctacttgtcgttccatctaagggcttgattggtaccttgttaacaaagccaaggggcgttaaacgcgcgttgcccattttggcaaatcaatcaaattaccaagatacaatgagaagaaggcgtaaaatacccagatccacgcagcataccgccatttaggtcgccagcccgctaaggcactcgtcaccgctaccatcactaacatcgccggtgcataggccgcaaacacgtgccaataggtcacccaactgatgggcttgaccatactcgtcaggcccatcaaatacataccacttagaccggcaagtaaaacgagcagtcccgttacgattgcccagccggtatagcttgcccacacgtgccaccgtgatgtggccgtcgcataaacttgatgtagatagcctttttgttcatcattgaccagtttgagcattaactgtactgctggaaccagtgcaacgatcaccatgacgatagccaacacagcaatgaaatttttgacgatcaagcgattcgctgctgctaaagctgacgcacctagcagttgtttgatcattggattgctctttgcaccagatcgccaatcgtattaaagacggacgcatacgcggcacctaagataaagttccctagtagccatgcaataatcagaccatgtgcctgccgccataatagggtcacgggaccccgcaataaaccgctagcctgtcgccgaccgcgccgtggttcgactaagcccacgcccaagtcccgataagcattaagagctgcagccaaacttaaacaaccaagacccagtaatacatacagaccgattggtaaccaatcattggtttgatacgcatctaatttttcaatccaaccaaaggggatccaccaagtcaggtctggacggttaacatccgtgcccattcgtgcaacgtacatgacgcccagtagcaaatagctcagcatcgtcgtaccactcgcactagtcattacctgtgcaagtaacagcgtcaacattccaaaagcccagcctaagccccctaagcccagaccaattaaccaattacctggcgtcgtcgctccctccggaagcttggcgacggtcagcccgagggcaaaaagaaaaccaatcaaaccatttagcgccgttaactcagctgccccggcgaatagtggtgctaaccgaccgaccgcgtgggcacgcactagctctagcaggccatcatcttcatccccgcgcgtcgtaaccacggccaccatgatattcatcacaatcatgacgatggccataaaaaccaccatttcagttgcaaacaccttggccgtcgcatatggcgatttggccgaaaacgcaccaaataaggaaatcatcgcgggcgttttaagcgttttgacaatttcattcagtgccatctgagtgccataaataccatcaaatttcgcggcgatggccgtgaatagccccgtcaacacgacgacccaaatgagcaactttttccaatctcgtcgtaagttgaaccgtatcagtaatccggtacgagcaaatagttgtgttgccatcagcatcacttccccttcaccggttgttgttcggtcgtgtaatagcgcatgaataaatcttctaacgttggtggggtcgttgttaagctgatcagtttccgactcgccaagtactgcactaccggcgtcaattggtcagcatcgacggccagactgacgtggttatctccgtggcgcgctgtgaccccgtgaacaccagctagggtggtcaagtcggtcaaaggcagtcgtgtttgcacatcgaccgtggttcgggtcaagtgccgcatctcagctaacgaccccgtttcaacaatctgtccctcacggataataccgatgcgatcacacattttttccacttctgacagaatatggctagataacaggacgctcttctctcgccgttttaaagccaatacttcattttgaaacgtctgctcatttagcggatccagtccggacgttggttcgtcaaaaatatatagatcagcatccgttgagagtgccgcaatcaaggccaccttttgccgattacctttagaactaagtgcgcgctttttacgcggatccagttcgaattgtttaattagcgcgtccgtcttagccgtatgctgaccaccgtttagtttaagaaacaagtcaataatttccccaccacttagattaggccataaataaacatcgcctggcacataagcaattcgcttatgaatcgccacactatcccgccagacatcgcgaccaaaaatcgtcgcccgcccaccactagcttttaaaattccaagtagtacccgaatagtggttgatttaccagcaccattcggaccgataaagccaaaaacttcccccgcgttgatttcaaaattaatatccttgagagcctgaaacttcccgaaatgcttttgcaagtgactaatccttaataacggttctttatccatatgactcactcccatccttcaaattcgagcatcttattgttgatgctgcaatcataggcgccgttgactaataagtcaatgactagccagtcaatcagttaaaaaaatttcattttaaacatctaatccgcttgaaactggcttcttaggctagtcaagtcaacaaaaaaactgttttggcgataaactttcctcgctaaaacagttttgtgacatctgaatttcgatggcagaaccagaaagatatatcgtcttcattagccactagaagatagttgggactaacccaccatccgcccgcaatgcttcacccgaaaaactgctagcaaacggactagcgacaaacactgctaaccgaccaatttcttccggccgaatcaaacgctgaatttgtgatagtggtcgatgattaatcataaagtcatgctcccactgatcctttggcaaatctgaatcagcatacatatcatctaacattttctgaacaccttctgttaatgtcgagccgggcataaccgtgttaaccgttacgtggctaccaactgttaacttcgacagactcttcgctaaagaaaggttcatcgatttagtcatggaaatattggggcatttccccgaaggcataactgcttctttactcgcaataaagataatgcgtccaaaatcttgggctaacattgcgggtaaataatgttttgccaaccgattgccagacaacacgttcactttaaagaagcgttcccaagttgcatcgtcaatctcatcgtaagccattggcccaaagattcccatattgttgaccaatacgtcaaccgttggaatttgttgaaacattttgtcagcttgctgcggatcactaatatcatacggtgccgccactggatgagttgttgggtatgccgctgcgagttcatccacaaccgctgccaccgtatctgtgcggcgaccattaatgaccacatccgcgccttccttggcaaatgctaccgcaattgcccgtccgattcccttagtcgaaccagtgaccaagacccgtttcctcgctaatcccatttccatgctcaaagttcctccgttctaatttaaattgctcgttaaagtctctaactagtttgatcaataaacacaaataatcggtcctcacgggtattaatctaactcgtttatttcccgggtaataatcgcaaaaaaagcacaccagtctcctggcatgctaattatgtacgcatcttaatccgcgcttgatttcgcatattcttctaacactggcataacgtagcgttgttctgcttgcttacgtgccatgatggcatcatccatatcagcaaactgctgattcaaaactaagcggccccgatacattaaccgtgcgacccacttctgtgagcatcggtcaaaggaaacaccaatgaccctgctccgattccggctattcggtttcaatcgatcgaccgaagttccttgataaagcggtaagttatcactacgtcccatatttttacgggtttgcggattttcaaaaatattctttcgactaacatctgcccgtaaacagccacagctcttcgtaatccctttccgtaaccgataactatcgacgaaaactacttgtcgtccacatgaacactgacacaaccaccgtgcattaccattcggcgcactttcagcccgttcgataacggtcaaacggctgaaagtctcaccagttaaatccttaagtcgcatcaaaatcacctcactaagctttctgtgtaatcagctcaattgtcttcaacacaatcgagcttgtactatttaagttaacccgattatatgaaatatttgtgacgaataaaaaaacttttatagtaaaattcgcgcaatatccattaatttccagctgattaactaacactcaacctattccagctttgtcttttatttagaatactactattatgattatatgtcactttttatcatttatattatcatcagaccggtaaacacaaaaaaacgttagtctcagaatagtctaacgttttatatgttaattgtacaaacaattattgccaatcacacaaaccagcccagtggcgcgagccctaaccagctcagaacgcacgttgacgttagtgtcagtcgcaatgaacggtcgtaaagtctgtttgatttctgccgcgttggctagcgtttgtagatcataccaatactggccctttttactatgaccaactaaggtccaccgacctaacgactttaatgccggttcctcggtgtcaagatcagcagtcaatgcgctcacaaaaacgtgcatcgtcggcatccaggccccgtcgtactgttcagtgtcacgccgtaactggctgatttgattctgcaaacgatgtgccgtccgatacagtcctaataccgcgagaagtcctactaacagcattagcatccagacgcctattaaatctgtatcaccctgatgaaggatcagtatcaaaaacaatccccataccacaacccccgcataaagactgaggttgatcgtattcatcgcctgatcacgtaactgcaaagctacttgcaaacgaaccttaggatcagttggcgccattgtcgtttgctgtaatgcttggttggtcactgccggtatacacaatctgaacatctgctgtacttgcacttgggcgagaacttgaaacgcgctgttactgttgctcatgtcagccgcgattgcttgcggcacatactcactaaagacccgataaatcgtcggcactttttaaactgataccaatttccatgaatagccatcaataaatagcgtcgctgcgcttgcgcattcagccatgccaactcctgttcagaacctttgatcaaaaatcgatgccgccacatacctaccacttccattttaaaagtttaaacaaatccaattggtgccaatcccagccagcttacaatcgatacagaaacgctatctcccacaattggctgtagcgattgcttgatttccgcagcacttgccagcgtcttcaagtcgtaccagtacatcccgtgatgatctttaccgacgtaagcccacgcccctagaccagccactttttctgtatccagctcggtggacatgttttttcaagaaaacgtgcatcgttggccgccaagcatcatcatattgttgcgtgatgactcgcagcgcattcgcctgtttatgcagccgacttgcttgccatgcaggatagaaggtaaatagcaaccatgctagcattccccaactggccacgttatcactcacattcaggctaatcacgatcacggccagtatcagaccaaccactaacctaatattcataacatttaacaagtgtccccgttgcgccagtgcaattttcaactgcaacggtgcgtcctgacgatccactcgcgccccccgcaactcagtctgagccgtgcccgtataaatcacctgtacggctggtttcgtcaattgtagccgtgttaacaattcgaacggtgtgtgctggtcgtcgatttcagttgcaacattaccgctcacatattcactaaagacttgataccgcgtcgccgttttttgaaattgataccagttcccctgatacgccgcagtaattgcccgcgcgttgtgcccgctgattgagccaccgtaattctgctctgagcctttgaccgccatttgataacgccacatatactcacttccccgttaaattaacccgttacaatcccgcctcgctcacaaatctgattcaataattgcagtcgttttcgttcagccgccaaaaccgattcaccactccccgtgatttcataggtatgcacgtcattttcgtcgactcgttccgtcattaaataatccttcgtcatggcatgcaaattcgtaaataaggttcctaatcctagctgtagttgattattggtcatttcagcgatctttgccggaatcgcttcactggtaatcggctggcgaacactgactaacactaagaacgctgcttccgtcattggttcatacttatcaattaatcgttgataaaagttagctggcatattttcatcccccttaatcagattattgaagcgctttctttttcaatcaatttaattatgggccaccgttttcttgaatgcaactccccagaataatttccacaaaaaatcggtagccactgattaacgcggttaccgattgctttaatgaatttgaacatccgctacgaccgtacttgtctcgtatgggaaatgtgattcggagacttcaaagggttgaccatcatccatgtaactaatctgattaatgaccaacacgggatcattcagagtcgcgcccattgcggcaacgtcatcagccgtcactcgggctgccgagataatacggtgtgaacccgcgattttcttgccactatgttgctctaagtaaccgtagaccgagccttcgaggacttgcttcgtcaacgtcacgatactcgttggcataatcgtatgctcatacgcccacaccttaccatcaacgtagcgggtccgccgaataacgtacaccggatccatctcatcgattaacaactgttccgcttcccgcttagtaggcaagcgagcttgtaattccaacaaccttactcgtcacctttttaccggcattcgtttgcgttgttcccaggggcttgtctaccagcgtttcttggcgccgttcagtcaaaccaaagtccttgcgaacaaaggtccccgcgccacgcttgagtaaaccatcccttcaataatcagtaattgaatggccttgtgaatcgtaattcgtgtcgtatcaaaagtttcagctaatttattctggtcgggcatcaattcgcccggcgtatatttaccggattttatgtcttgtcgcagactatccgcaatcgtttcatacttataagccaaactactcacatccccttcatcatttggtcttgtcaactagtttaccccttttagtagctaattgaaatcatttgtatatacttttattggctttatttaattaacgaccaatccaactaatcatcagcatccgtcactgaccgtatagccgaatgaatcagcgcatttgaccaccatttaatcagctgttcccgattttgccccgttcaatctcgatgtaaccggctacatccgttcggttttacttgcacccccacagactttggcgtatgctttaatagttaaattcagattagaaaaagctgtgacaagatgagtaagctaattctcgtgcttagagagtcgtatttttggtgcaaaacgatgacgtggttagttgaagatggtcttgaagaagctactggggccatctcagtcggagcgatccgttacgatcatgataagtccctgtgggaaaatctcggtggtaacacgcaaacgcgtcctagaaagcattcgcttttaggcgcgtttttttatgaccataactgatctgaaattaacgcctgttcgcttttattaatggttattagaacttattcattctcaatacttaaggagtgttacactatgcaaaacaagcaatccaattcaattcgtaccgtcgtggctaccgggatcggcgccgccgttatttttgttctcatgaaatttgtcgccatattccaacgggtgtgccgaatacccaggttaacgtcgcgatggggtttttagccttactaggagccatctttggtcccgttgcagctggtttagccgtgttcatcggtcacgccttaaacgacttcgtaacttatggttcgccttggtggacctgggtcatcgttgatggtctgattggggttgccttcggactagctaaaaatcggctcaagattgaaaatggcgtactaggaacggcaaaattagtctggtttaacatttaccaaatcatcgtcaactttattggttgggtgcttttagcaccaactggtgatattattatttatcatgaaccggccaacaaagtttaccttcaaggtgtcattacttggatcgccgattccatctcagttgccatcattgggaccatcctactagtcttgtacgcccggacgcggacccaacgtgggagcttaacaaaggaacgttaataacatgagcgcacccatcattagctttaaaaaatttctcttttcaatataatagccaaacggaaccaactttacgtgatattaatctggatatttaccccggtgaaaaagtgttgattgctggaccttctggctccggtaaatctacattaggccggtgtttgaacggcttgattccgcagtcctatccaggaacagtgacgggccaagcaaggattgctggtcaaaccattactgagagctccatttttgcattatcccaagacgtcggtacggtactgcaagatcctgatagtcagttcgtcggtttgactgtcgtcgaagatatggctttctcattggaaaatgatcagcagacccaaccggccatgcgacaagcaactgaacagtgggcccaaactttagacctccaggacttattgactcaccgcccgcgggaattatctggtgggcaaaagcaacgggtcgccatggctggtgttctgatcgacaatagtaaaatcctattatttgatgaaccgctagcgagagatctcttgatccggcatcgggtaaagcctcgatggcactcattgatcagctgactcatacgcgaggacctgaccgtcatcattattgagcaccgcattgaggacgtgttacagcaaccaatcgaccggctgattgtcatgcaagacggcgcgatcgtcgctaacgaccggccggaaacgattttgcggcaatcactcatgactcaactcgggctacgcgaaccattatacctttcagcgctcaaactagccggtgttgatctagcaacttgccaacacttggataacctccaagccttacaagtacccgacctcaccgcgacgttgcaaaactggaccgccggcgtacaactacagtcgcccaccgttcatgaccaaccgttactcgcaattgagcatctgacattcgggtacgatcccgccaaaccaatcatcaacgatatcaccgtcacacttcatcagggtgaaatgattagtctagtgggtcaaaacgggactggtaagagtcaacattaagcaatctgattactgggtttttgatgccacagtccggcaaaatgcgatttaacggtcattccctagctgaccaatcagtcaaagaacgtgccgaccaaattggttatatccttcaggaccccaatcaaatgatctctaaaacgatgatttttgatgaagttgctgccggtttggtcctccgaggtgtcgctgacgatgaagtaaagcgccgtgtccaggccgttctgaaggtctgtggtctctatgagtttcgccactggcctatttctgcgctcagtttcggtcaaaagaaacgggtcacgattgcggccatcctcgtattagaaccggccatgctaattcttgatgagcctacttcgggccaagacttgcaacactatactgaaatgatgaccttcttaactaagatcaatcaggaacaacacatgacgattatgttgatcacgcatgatatgcacctaatgctagaatacacggatcgcacgattgtgttgggccacggcaacattttgatggatgctcgcccagccgatgtgttgaccaacgcatccattattcagcaagcttccttagccaagacaagtttatacaccctggcggaaacgcaccatttaaacccgacagaattcgtcgcaaaatttgttcaggctgaacgggaggcgcgctaagatgcaacatgaattattgatcgggtacaacgaccgccatacttttctaaaccggcttagcggtagcactaaactactctgctttgttggcttatcagttatcgggatgatgacttacgacacgcgttacttaatcggggtgatgattttttcactgattctattccgcttttcaaaaattcattaccgcgatatcgcgttcgtgcttaacgttattattggtttttccgttttaaacttagtgatggtgtacgtctttgcgcctcattatggcgtctcgatttatggtaccgaacacttactactgggatctgctgatcatctattttaacttgacagccgaacaacttttttatgaatttaatttgttattaaagtacacgtttgccgtgccactcgccctgatttttctcatgacgactaatcccagcgaatttgctgcgagtctcaataagattggaatttcctatcgtatcagctattccgtagcgattgcactacgttacattccagacgttcaagctgattaccgtactatcagtctggcacaacaggctcggggtttgaaatgtcgaaaaagcgcattttatgacccgtattcgtggcggcatccaaattctgcttccattgattttttcaagcttagatcgaatcgaaaccattagtcaggcgatggaattgcgacgcttcggtaagggaaaacagcgcacatggtacatggcccaacgctttaaacgtaacgaatatctggcgttaacgttagttgctctgctgatcatcctcggcatcgccctctttaaggtcaacggtggccgtttctggaaatccgtttaaggcataacgttgcatcataattttccaaaaaacttcgtcgaccatgcttatcgatgaagttttttgtttgcatctacctatcaagcctcacctgacttaacaacagcaacaatccccttattccacacgcaccatcctgttatgccaagattaactaaaaccagcgactttaaaattgaaaaaacaaatttcaaccgctaaactgaaactagatcttacaaaaagtaagcaaaactagcttgaaaggatgttttattgtgactagttttaacgaaccactcaaattcaaatctggcgttacactacgcaaccgcctaatgatgtcgcccatgacgacgactcaaagcttttacaatggtagtatcacccatgacgaaatcgactactacacacaacgagctactggcttaggtgccgtgattacgggtgctgccaacgtcgaagatctcggtaagggttggcatggcgagcttagtatcgcgcatgacacgatgctgcccggtctaagtgcacttgctcatggcattcaaagtcaaggtgccaaagctatcgttcaaatcttccacgccggtcgaatgacgcatcgagccgtcttaaatggcgaacagattgtctctgccagtgccgttgcggcccttcgtgacgatgcggaaacaccgcgagcaatgtcgattgacgagatccacgcaacaatttcagcattcggtgaagcaactcggcgcgcgattcaagccggctttgatgggattgaattacacggtgccaatacctatttgatccaacagttcttctcaccacatagtaatcgccgcaccgatgaatacggtggtcgcacgccgcaagaacggttccgctttattgatgaattattaaaggccgtctttgcagctgttgaccaatatgcggaccggcccttcatcgttggctatcgtttctcaccagaagaattcgaagaaccaggtattcggcttgaagataccccttttggttactctcacaactacgggaaagtcgattagattacgttcatgtctcactcaacaactatgaccgtgtttcacgagacccgcagtatcaagataaatccatcatgacctacgtgcacgaagcgttacaaggtaaattgccactagttggtgttggtggcgtccggacccgcgacgatgtcaagactgtgttacaaactgccgaactagtcgcagtgggccaacaattactttatgatccaacttgggccgtcaaactcgctaaaaacgctgacaacaccatggttacggcaccatttgaagaagccgttgaggtcacaccacttagccggccgctgtatgaatttgcagcctcgcgctatcacagcgtcattaatagttaacctgtcagccgaattaaaaacgtccactgaaaaaatcagtgggcgtttttatgtttcacgtgaaacatttagactttcaataaccaattcagttgttgtaacgcacgctgatggtcaccttgatattgacgcgcaatatagtaataggctaacgtttcatgggccgttgcttgccggtcgacgggcaattgatactgttggtcaaagacctgttcaaatgcttctaatgtcggcgcagctggctgttcacgcaaacaaaactgtcgtaattccgatctagtcatccggtcacgggcaatcggttggcggtcttcatgcgcagccaaacgttgctgtagtgctgcttgcataccggcatccgcattgtccgcaagccactgttgagtttgtggcattgtcgtttgcatggctaattgttcaaaccaagccagcgacaatgattggccccaccgggtcgtcaataagtgctcccaatccgcacgttgggtcgctcgctgatgatactgccagccccaacaactattgaagacatcgtcataaaaacgcgtcgtttgttgttcatctagctgttgagtcacctgattaagtgcggcaacgaactgatgatcaagcatggctaggcgccgaacttgaatcttcccagtctgtcgatattcagtcaccatttgcccgaattgataagagttcaccaaagggcgttcggtcgctggtggcgtgatttttcaaactgttgcttcgccatcggtcgttccggacgcatcacaataatggccgccagctgctgtaaataacattgataggcgtgactctggcgcaaggtttgctcggccttcacagcactttgctgcgcttgtgcctggcgttgttgttgattagtcacaattgcttgacgggccgcccgctcagccgcttcaatcaccgtttgttcatcatggactaaccgctgataggtttgttcagcgggctttagttcctgtaatggtagctgcttggtacgacgttttaggtacgtcgtgacggtttgcgtcgttgtttgtcgcaacttgcgcgcttggggcgcttgctcagccggtaattgtggtagccacggctgagcaaacatgatcgatttggcactgttggtacagcggtagtcagcgtctgatactgggccaccgcataaaagttatcttctgttgtaatcaccatcaagtaacgcgtttcggcgttcatgaactttttgacgcattcagaaccgacaatcaactcacgataattatgcttgttttgaacatggtactcataacgaaccggcttatgacacaattcgcaatgatgccatgcttgtcggctttcattcggattaacaacgtacggcaagctcgccaaaagttgccactcatgactacagtcagtcagccattggccatgatcttgtaagatcaaattacgcacagtcggtttcaagaaatcactgtcagcctttaccgttacgtgtgcgcgtaataacgcactaatttgttggagcgtggtccgccgtcgagctcgttcacttaacagaaagaaacgattttcagcgggggttattaaagttgttgctgccggcaatgccgcccacccctttcagtctgaaaaaaataccgttctagcataccataactttcccattcagtgcgaacgttagttctaaaatctcggtcactctcattaacccaacggttactcccatcgcggttcgtttgttatcaagcctttattgattgcattcaaattcacccactttttgataattttattgatattacgattgttgcaaagcagtcaaggtgctaaactatcttcgaatcaaaaagattcactttaaggggattttgaaatgaaaaattaacatcagtcgttgcaacacttgctttggcattaccattggctgccagcccgtttgccatgactaccacggctaatgccgccacggtaaccccaaaagccactacccatgcacttactaaagcgacccactttcccgccatcacaatgcacgcgaaggccgccacgactttgaatacaattcactttgccgccgatcgggcaatcgcctttgttagcccggccaaagcaaaactcagcactaagaaagacttacacggtaactaagacgattactttagcaaccggcaagcatacgtcggccacatattatctcattagtgaacacggtaaggccctcggctgggctaaagccaccacgatgattaaagggaacgccccgaccgctaaattaaaagcgaccaagaaaaccccgaggactaagttgacgattgctaagaagaccaccaagcgaggctggacctaaagccaccagtactaagaaagcaacgcctaaaatcaaagcctctaaaaaggtaatcaaattggcaaagcagacgaccaccaaagtaaaatcaacgaagctaacgatcaagcaccctaaggcaagtatcaaaccaactaaaaaggtaacgactctcgccactaaaaaaacgttagcccaaccaacgaaaactaagaaaatggcaccaaaattaatcaaaaagaccgccaagcaaaacgctaaaaaggcgcccaaacttgcaaccaaaaagcatctcacggtttcaaaaccactactaaacacacaccgtctaaattaacacctaaagcagctgctaaaatttgatcaaccactaaattgcttagcaacctgatcctgttaatgacggcgtctcaacgagccgttactactgatcgtgatgcacactaaaacgctccctatgaaagtcatctttcatggggagcgtttttaaatcatgccatcatcagtattaaccactgacaggccagcatttaattaatcaaacatcttcttagttgccttgagcaaggtctttggatccttatcgtaccgtggtgtcttgaccaagttatccattgggaccccagcaaagtgataagcggcaatctcaccagagcggaccgcactctgttccgtgaagatcatctggtatggttgttccgcaaattcacccgtaaaggctaggttcgttgagtgctttggtaagacttctggccgatcagacttagcccggttattaaagagtgcggaagcatatggcatgtataccggaatattgttcacaatactgtccaaaatttccttttccttgtccttaatattgcctggacccggatctactttggaaagttgaccaattaattcttgagccatttccttacccgtcatcttgatatacggcttgttaacaaactcaccttgacgccgtggatacaagaagtagccccacagaactgtttcgtttggttgctgtgtcgtaaagtgtggttggtggtgcaccacgatcgacatattaacatccttttggttcaacggcgtaattggcgtagttgataagaaggagttcaacgcattcccgggttcctgggtggtgatccgaacgatttcatttaagaataaatgattcttagtcgtcaacgtgaagctgacccattcgctagcattccgatcgttgaagaacttatctggcgtccctaagttatagaaccgctcagtagccttcttccacaaactagcactaacaccataatccatattttttcaggagcaaaggcgtgttgtaatcacccatcgttgcagaatcggtaattgaaccgttagtgaagatcaccgctgtgtcctcatcaacttcaacttcttccgtttcgccagtctgcgcatcctcaatgactaagccagtcaccgtaatttcgtcttgcattggcgtgtctttaaattgccaatccttaacaatcttattatcaatgaaagtcacaccttgcccttgcaagtacttaattaatggcaaaatcatgctttcgaattgattgtaacgcgtccggttgacaccaactaagtgttcaatttgtgtaaattcataaatcatttgatgcatgtaacgccgcagttcttgagcagagctttgcgttctaaaggcaaaggttgtttcccacatataccagaaattcgtttggaacatatgcggatcatccttgaagtactcagcaatcgaaacgttgtcgagcttcgtttcttcactatctggcatcataatcaactttagtcagcaaagtccgatccttattattgaatcctaacttaccagcattaataatgcctttaccaccccgcatcaagcgggcaatatcatacgtccgatgtttcgcatcaaaatcacgcgtatcttcggccgccgtcatccccggttcagttaccgatggaatccggtccaataaatccattaagtcaacgtacgtccggtaattcagcatccgaccaccccgggcaacatacccagtcgtgttagccatcggatgattcttattccaatactcattagtaaaatcagtcgtggcaccaccatcattggcaccgtgcatatcaacaccatagaatgtgatgtccttaccatcccaatgaccatcttgaatcaagtagaccgccgcagccatatttgatagcccggcaccaatcataattgctttacttttaaccataaataacgcccccaaaataggtaattaggttctgataacgcttacaagtacattatacaacttgggatagtgattgtctagtttgaactgaactttttgttttcttgccgctttcttaatatttgcgctagtcaaccaatttctgcccatagcgtaacaccatttgatgacttttctccaattaaacacattgcctttaacaaatattacatttttcaagcggctcattcccaccacaagttctgccatttatgtatgcaaaaagcgagccttgacaaatgcagacggctcactttttattttgactaaccgttcaaattaacgaatagttcctgtatattgaaaatcatcggcagtgggatcttgtagaaaagccttcaaatcagtcatgttctcaataaccgctttgccggacttagccagcatcacattaaacgtgccatcagctaacgtttcaccatagtaagcaacggggatatctaaaccgtatgctgttccagtttcccaaatagttcccgtgtcaaagccatcaaccacggcgacaactaacttggcccgttttaaatggtccacattgtccgtaaataccgcgtttcgatcagcttcggtcgcatccggcgtcaaatcgatgccgtctagccgtggactgtaataagtcaattctaacttgtccattaatttttcgatcttagctagccgttctggttggccctcagtaaaccaaggtcctgctaaataaattgttggctcatcactcatcaaacgcgtactcatttgctcaatcctctttctcattcaatgtttattcattttaaccgtcaaccccatgaatttcaagcgtcgtttagctcgttttaggcaaacaaaaaggtcgggaattcccgacctaaatactcatttaacacttaattgacttaatccattaaaatcggccgttgttaaatcaacgttggcggctgccacattgtcccgtaaatgctcaatagaacttgttcctggaatcggtatgatattatcagaccgcttcaatagccaagccaaggcaatttgcgctgggcactcacctgatacttttgggccatcgtgctgaggacactcccagcctgagccagttcacccgttgctaatgggaaccatggcagaaaagccatcttttgtgaggccgcgtagtcaacaacgtcatcatcaccgtgattggcgacattatagagattttcaatggcatcaatcttagcgacttgctgcgcttccttgatttgatcaacagttacttgactcagaccgatatgcttgattttaccttcatcctgaagctttttgagttcaccgacttgatccgcaatcgagtaatgagggtcaattcgatgtaagaatactaggtcttcatggtcaatccccagtgtcatcatcgaaacttctacttgctgacgcagataccgtggctcaccaagtggcgtccacacattcggtccttgccgcgtttgaccgaccttatcagaaatgaagatctgatcacgattagcggcatccttcaagcccgccgctaagtaccggtctagcaaaccatggaccgtatgaatcagccgtatcaaagaaattaacgccatattccagtgctttcttaactaccttgaccccattttcaggatcagcgtatggtccccatgtcccaggacccgttaactgcatgacgccataacccatacggttaactttgaattgatcatcaaacgcgtaagtacccgcgttagctgcattaatcgttgtcatcaaatcgctccttatcgtttattaattatgttcagtttactcctatcgacccaagtgcggtcaaacattttgttcgttaaccttgggttgggttgtgcatgtatgaaccagccgcatctggcaagtcgtttaaggcttgcatatcggccacactaattgcgaagtccaattgcgtattcgcctcaatatgggctggattaacagccttgggcaatggcaagaccccattttgcaaaacgaagcgtaacgctaactgcgccacactgacgccgtatttatcggcatagggcctgtacttgcggattatcgaggaccccgcccgtcgctaatggcgagtatgcttctacaagcatggcatgttcctcagaaaacttggtgatcttaggttccgtgaagcccaagtaatattgaatttgattgatcattggtggtatcgtcgcctggttaagaatattcttcaaatcccgaacagcaaagttagagacaccaatcgctttcgcccggccactttgataaatagcttccattgcccgccaaacatcgaggttagcttcatcgtaaactcgaccgacttgcccccatggccaaggtgcgtgtaccaaatagagatccacgtagtctaaacccaaatttttcagtgagcgatcgaaatcatttagtgcaccttgatatgacttcgtttcggccggtaatttagtcgtcacaaagatttgctcacgtggaatgccagaatcacgaattgcctggccaacgctagcttcattttgataggccagtgcagtatcaatgtatgccggtatcccgctgctaaggccgcacgaacggcttgatacgttgcctcaccaccaggtatctgccaagttccgaatgcgactttgggaatgttgacaccatttgctagttgatacatcgttgttaacactgtcatcttatttttgctcctttactggttttgactgtcgttgctgagtgggatcacctacaaggcttgccccgatgatcgccacgccgacgaccgttagaatttgaataaccgccatattactgtggcctccttaattgaatagagattagtgtaatcccttagagtaactctaaggcaaagataaagtttcaaaaaagaacgaaattgacttgggccaatctcgttctgcattattgtgatattaattactcataaatcgttgcatgctggaaaatgatgctgccggataatgctagtaacgcggaaagaatgatagctaaccagagtactggtccccagcctaattgaccgcctaaccagccgaatagtacgggccccactgcagctaacaaatagcccgcggattgggccataccagataagtcagccgtttcaaacccattggtcgttttttgcgtaaagaagacgactgccaaactgaaggctgctccagagcctaatcctagtaagacgaggacagtgctgccacccaaaaattcgttccggaaagtaagataccaccaattcccgcaataaaaccgacacctaccaccataatcattgcccaaacgccgcgccgatgaccagaagtcgctggcactaaatatgacatcggtaggccgctcaattgcatgaccgtaactaaattaccagccacaatcaaggagaagccgtgggcaacaaataccgttggtaaccaagtcagtaatgaatagtagactagtgcttgcaagccgaaaaaggccgtaacgacccacgctaacggccgccgccaaacactcccgtgagttgccgttgactgcccatcactcgcggtcatcgaccaactgttggtgcgcgatgattatatttcaagtttggcaaccagacgaccaaattaattagtccaatcaccgatagcaccgccatcgttagtggtaacgaccagtgtgccgccaacactcccgaaagtcctgttcccagtgaaccgactaatagcattgagagcgtgtattgactagttgcaactggaatcttcgtcggaaaattatctttaataatcgctggaatcaagacgttgccaccgtccgcgccaatcccgactagtaacgtcccaatgaaaagggccgcaatcgttgggatgacccgcaaataactcccaacggctagaaagatcaacatgacataaattgtcagttcgttgccaaatcgccgcccccaatgtgcaatcaatggggacatgatggcaaacgttaataatggaatcgtggtcagtaatcccgccatcgagctcggcaaacccagtgtccgtttcaaagaactgattaatcccggcatcattgtaaattggtaaacgcatattcgttgccgctaacatcattccaagtgttaagtagcggctatgttgatgtgttgtggtcataaatagttgacatcttctttccaaggttttagttcgataattgtcgaactaaaaagcaaaaaactaaagcgttgctaagaaccccggtaaaagccggtcaaaggtcgctaattgtaaggatagatacttcgtctgtgcttctcgtcgcgtattggtaagacccactaaccgcaaggccttaaaatgataagagacggttgacttgctgatatttaattgcgcccccacttcgctgcaagtcatttcccgttgtgcttgatagagcacccggataatccgtaatcggttagcatcggccagtgctttgaaaatcgccactcgttgctgatcagcctgatcttgtttgcttatttcgatattcatgaaactaacaatacaccgaattaacatcatgttcaaggacaagtaacaaaaaaggcagcattagccaatttaattgactaactaccaaacacctaggaaactgtccgtttgccgttcttccaaatatcaggaactagccacaaaattaaacctaggttaattaacaaaagtaacgccgtcataatgaataccgcgttgtaattgaaccaaccagccaccaaaccaccgagcaaggcgccgaacatattgccaatagcttgaaaagattgattataactaaaaatcgttgaggtaagatgtactggcgtattcttagtcaaaaccgtttgaatttctggatatagtgcgccatcggaaatcccaatggcaaaccgcaaaataccgagggccacgacgctcgtaacaatgccttgtgggaaatacataatcaccgcaaaaatatagccaaataacaataccttaccagaaccgtgctgatcaccataatgtccaaggcgcggtgctgaaaagatgtttgaaatacccggtaaagctgcgataattccggccacaaccgtaatcgggccacggtaatgcatcaattcacgaacgtataaactaatgattggtgcaatcgaggcgtttccaaattggacgatggccgtcgaacataacatcacaataatcaagcgcggattttgaaacgctgctaaaggattgcgactgtcacctggctcacgatgatgtgcgactggtttgaagtgttcctgtacaaagaacagactcaacaaaaacgccaccattaataatccggccgtaataaaaacgtgtttcgaatcgaaaacaattgggctagcaagcccccaatcactgggccaaacaattgaccactaacggcaccagtgatcaaagtgctcaacgcccgtccactatatttacgtggcgtttgggacgcgactaaggcttgggcattagaaataaagcccgcaaacacaccttgtagcgcgcgcaaggcaactagttgccagacattcgttacaaaacccattaaccccatcgcaactgccatccctagggacgcgcgcaatagcatgatcttacgacctttttatcagcaatgatgccccacagtggtgccgaaattgctgaaatcgcgtaatcagctgcaaaagctaacccgctataaaatgtaatctgggccttcgtgaaatcacccaactgactaacaaataatgaaagaaatggcataatttcgctaaatgccattcccgcaacgaacgtacaaaaccataaaacaatcaaattacgatgccatggtccgcgttcacgttctgcgtcatccacgctcgtcatctccatatctaactgacactaattttcagtaagtattataccgttaattagcttatcatatttagcgaccaccagtgacaattatttccgggaaattttttgtcatatttcctgaccagttagcccgtttagttgaccaagtagcaataagcactagtgtcaagccgcatttttcactacaataagcttatcaaaatcgctatttaagggggaatcagcgatgcacgtccagttaaccatctctgaaacgattcatcaatgtttttcaagatcgctcgctcattaagctgccacttcaatcggtgtcacgtttttacactgccaataaacgactttattgtgaaacaaccactggtacttacctcgttcacagccacttacacactttaatggaccaactgccacccagctttcgacattattgtggattctgattggtgaagcttgggcattcagcagctggctgttcgaaattgaaacgtggtcgattacgaaacaaaccattgttcattgtctgtgttcttacctagggatgaccccacttgcgattctctgtggctggtttccattaaacgttcgctggtttggcttctataccttgatttacatcggagcctatatcggtctatggttaatcgaaatggcactcgcccgcatcaaagtcatccagctaaaccaacagcttaccaaccaccagtcataattcataccgattgttgatgtccaaaagcggcccaccgatttgattatcggtgggccgctcacttgttactgatgatttaattattgaatttcgatttgaccgtcattcgtgctcggctgggtcttaggtaacgtaatcgttaagacaccgtcagcttgggatgccgtaattttatccgccgcaacgtttggtaacatatactgccgttgcaaggtgccagtatgacgctcattcatcacaatgttttggtcttgatcttcatgatccacaaagctatctttttgaaccttgatagacaacacattgtcacgataatccaacttcacatcttgcttatcaataccagggacatcaaccttcacttgatactgatcatcagtttcgttaatgtcggtcttcaatacttgatccatgttttctaatggtgcccagaaggagcgtgccatccgttcaaacggatccaacatgccgaaatcgttccgattcattaaagtattagccatactaacaatcccctttcacaaaaaatttcacttggctattaatactggtcagtaattcaaatccttgtttgacctttcctgaccttcgatatatatactaacaccattttgtgggaatgcaacaatttagcactcatttaaccggagtgctaaattttaatttcacgaatccgtcgcattaggctaacaaagcgtctcagttccgcgtcagaatagtcatcagcaatggcttgtgctttagcagcaatggccgcgtccagttgcgtgtgtaaatcagcgactgcttcgcccagcgtcgtcaatcgcacgagaatttctttgttattggtcaaatcccgatatttcgtggccaatttcaatcgggataatttagtcagaccgcgagaaatcgtcgcctgtgaaagttccgttggtgccggtagcgacttagctcgactggcaccacgccgtcccagatacgcaataattttaatatccgtcgtcgatagttgttttaatgccgcttgtaattgcggatcagtcgtttgttgcatggcccagcgttttcttgatcaccaacgctatcctgcgtcaaaaattgatttagttccgtcatcaactgactaactaatggtgttgtcatttaaaaagctccttttaattcatgtgaatagacacttgcatactaatattattaagtctatactatcattttgtattcattagaatcaataaaaatatctggaggcctcactatgtttaaaattgcaatcatcttagggagtacccggtcacaggctaacggccgcgctttatttaatcatttaaaattaatcattgaccaattaccgactcattctccgattcactaccaatttttagatttggccaactatcaacttccctttttcgatgaacccgagccaccgatggcgaacccgcaccgcgagctacccgctaaccagcagcaatggctcaccgatatggctagtgcggacggttacattatcctgacacccgaatacaatcacgcgatgccagtctggattgaaaaacgccttcgatttttggcattcgaaggcgcccgtaaaccggctaagattatctcatattctgacaatatgcgcggcggtcaatttggggcggccgcactagttccagttctccaacgattaggaatagtcgtcctccctaaaccaacgcccattggtaacgtaccacaaacccttcaaagtaacggtcactttatcgataacgcgcccctgagcaaacgctacgatcatacacttcaccaagctttgactgaaatcacctactataccacggttcttaccactacgccgtttccaaccgattaaattagtagcgttattgaatcaaacccgctacattatagttagcattattaaggggaattaacttatgaagatcgatattcatcgttccgcaacggaccgggtgattgccggtgtcattggtggaattgccgaacattttaactggaatactaacgttacccggctattatttgttgttttagcagcaattacacccatgttccctggtatcatcgcttacctgattctctggttattaatgaaggaccccatcaaggattagccactattaacgaacagtcatcgactgctcgtttttattcgctaatatgcggccaaactttccacagctagttcaatggcagcaagaacaccgcccgcaccccaatgtcgcggatcatagtgctctagttgtgctaaggtgtctgccgtatatagtaattgtccaaaggaaacttgccgaaacgccgaacaggcagctaaggccgaacattccatttctacgacttgacaaccccgctgacgagcagctttgactttagacacagtctcacggaagaaagcatccgttgtccacgttttgaccatctgccatggcgcggcaagccttcgtcaatgttgtcccgagtacctgtataacctttggatcgagtggcacccaatcagctgctgctaaataatgaaaggacgtcccttcatcacgcaaagccaccgttgggattaataattgttcctctggtagtgctgttaatgcgccgcaactaccaactgctatgacggtacgagcaccaaaatcaatcaacatctctaaatacattgtcgcagctggggaaccaaggggcgcttgcgctactgccaatttttgaccacgataaccgatttgataaacccagctaactttagtaatggtattaaattggcctaaacggtgaccatgataccgagtgacgaattgttgaaaataatcatcaccagaaaatatgtagagtagcttagctggaacagtaaagcggccatccacgtctggccctaccatagccgttggatttggatcatattgcaataacgttaacttatctgtcatcttaagttctccctatttaatttacccaacaattcgaggaaaaccagtcattttcagcgacaaactagccaaaatctgatatattattgcaactaacgcaataatttgtcatgaatttgtccaaatattttaatggcgttcacctagattgttcgtatataatattatttataataacgctaattaagaaaggatgtggcgaaattggcctatttagcacgcaataaacgtcgtgattttacagaacctcaccggtaataactttatttttaaggagcgaattgaatgataaaagatgacaatcagtcgttaacctctaatgaagagcaaaacgacacccagaaccctcccgatgcggataacttatggcagcttgatgaatcagccttagccgcaaagtacgccaccgatcctgagaatggattgagcactgctgaagctgccgaacgtttacaacataacggtcgcaacgaactggagaccaaacgtacgtctcggttcgtccaattcatcaagcagtttaataacagtattatctacattttagccgcagcagcggtcttaacgttcttcatgcaccactattccgattctatcgttattggactggttattattgcccaatgccatcattggttatgtccaagaacgccaagctggcaacgcgctagaacggattcgtgaaatgctgatttcaagaatttcgtcatccgtgatggaaaaaaactggaaattgacgcccgcgaattagtcgttggtgacttagtcaacttagaagccggtgacgcggttcccgccgatatgcgcttgatttcagcggataactttaacgtccaagaatccgtgctgacaggggagactaatcccgtggagaaacaagaagaaccgatgactgagaccacgccagctttggctgaccgtaagaatatggtttacgcgtcaaccgcggtgactagcggttcggccgtcggaatcgtaacggctaccgccgaagataccgaaatcggtcatatccagcagtctgttagtgacgtcaaacaaaccactaccccactgatgcgtaatctgaactcactggggtttggcttatccatcgccatcgtggtggcggccgtcctattattcctattaggaatggtcatggatacctatagtttgccaactttactaattgcggttattacgatggtcgttggttctatgccagaaggactgcccgctagcacctcggtggtcttagccatgggaacccggcagatgacgaagaaaaacgtcattgtcaagtcactacccgccgtggaaactttaggtgccgtagatatcgttaacaccgataagactgggacgttgacgaaaaatgaaatgacggtcactaaggtcgtgacgcctgagcatacgtttgatgtgacgggggtcggttatgatgataatggtggcgttaacttcgatggccatctcaagctcaatggcaacaaagtcgactggcaccaagataacgcgatggaatggctcgttaagattgccggccaaacgaccgacgccgagctacacttcgaaaacaatcgctgggaactgactggtgaaccaaccgatggtgccttgacgacgctgtatcgtaaaaaatgactggtcatgatcctgaggttgaagaagtcgactcgctaccattcgattccgccttccgtttttctgctcgcctggccgacttagatggtcaacgcttactaatggtcaagggctcacccgcgactgtccgcgtttaactgaccaagctaaccaaacggcatactgggatgacgccatggacgacttaaccgccgatggtttgcgcgtggtggcgctggcttaccaagaagtcgatgatgacgtgactaccattgatgcacaagccattggtgggctgcatttagctggcttagtcggaatcattgacccgcctcgtgaagaagcggctaccgcgatcgccgaattacggcaagcgggcgtgcaagttaaaatgattacggggaccaccctgatacggcgatggcaattgccaacaagttgaacttggccgccaatgtcaaagcgattactggtcccgaaatcgacgcgatggacgatcagcagttacaagcacacatcgatgattataacgtcttcgcacgggcaacaccgaataacaaattacggattgttcgtgcccaacaggccaataatcacgtcgtttcgatgactggcgatggggtcaacgacgccccggccctcaagcaagccgatattggggttgctatgggaatcaaggggaccgaagttgctaaggaatccgccgatatggtcctggccgatgatgactttgctgatatcgtcgccgccgttcgtgaagggcgccacgtcttcgataacattcgtaagacgattcgcttcttactcccaactagtttcgcggaaggcctcgttgtcatcattagtattttaatgggccacgaacttccgctgtacccgacgcaattactgtggatcaatatggtgtccgcgctgaccatccagtttgcgttcatctttgagccacccgaggccggcatcatggcccggggtccccggaatgttaagtctgggttgttgtcaaaattagattactttgaaatcggctatgtctccttcctaatttctggcttggggatcttcgcctacaactacttgaccgcacttggattaccaaatgtcgtcggtagtaccatgtcactgaacatcatcatctttggtaagattttctacctcttcaacttgcggaatgaccaccccgtcatttccaagtacttcttccaaaataagatggcgttctacatcattggtattctgattctcttacaactgggaatcatttacctaccattcatgcaatccgtcttccatacgactagcatcaacttctggtatggttggggcatcccgattatctgtgggatcgtcgtcttgattgtgaccgaggtcgggaagtttattcggttccgatggatgggaaaagatggcgtgattgattagtaattagtcaataaatcgaaaaggctcaccaacctgttttagttggtgagcctttttagtattgtgaaactgtttttgatgtggccgttattcaagacaacataatacattatgttattctaaacccgcttgatatgactactattcaagactgtaatatcacctttaatacaggtgttaaaagtgttttgcgtttagcacgtcgccaaaaattccaacaacgccttattaaatgctgccgactgttccgccatcacgatatgaccagcttccggaatgaccacactctgtcctcgtagtgccatttgagcagtcactgccgcaaagtcgggattgaagaacggtgacttggcgcccgcaatgatcaagaacggtacggtcaattggcggatcacatcccgccaatcctgaaccgcgtggttaaccaacaatggaaacattaatttcgcatcgaacggtgccacgcgcttctactgccttgacgcgcgcatacgtcgcatcatcgatgtgcttaaacgtcgagtgtcccagcggcattctaaaatagtccggaatatcccgccattgaacctgtttgaacccatattgccagtgcggtgtattgatcatccgcggcgtttgatccacgtcgatcagggccttaattcctgtatcaccatacaatgacacgtacgcaaaccaagtcgcggcccccatcgaattaccgagtaaaattggttgttcgagttgtaatttttcaatcaattcatgcgcatccaccgcgcgacgactcatacgtaagcctttcgccgtgtgctcggataaaccttggcaccgcccatctaaattaatgacccggtagcccgcctgaatcagtaccgggatttgagcgcgccaaatatccttagcgccaccaaatcccgtcaaaataacgattggctgcccctggccttcatccgtataatctaactgaacgtgatctgacgtgataaaatgcatttcaccatcctcctttttgactgttcattcaacatggctgttaaaatcttgtggcgttagcttctgtaatttttctagccattggcgcgttttgtcatccaacccagcttcggaaaagtgtattctgggcaattactgtcgaatcaagcaactgagcaaccttttcccaatcaatccccgttgctgtttgaatactgttttgtagctgtcgtacttgctcagtcgttatttggcccaattgtcgtgaatcaccagttaatgctaatagggcattgattgctaattgctctgataggcggcccgccacgtcgctggggacagtgcctcagttaacgtaatccgctcacttaacggcacagccggcacttccttgttcagaaaagccgtccagcgtgccatttcctggtcaactaaggcatacccccgccacggtaactgccgattaaaggtctgtaacgtttgcttcgtcaatgccactactgaccacgttgtctgaccattgtcgctcaattctgcttgcccccgcggctaaccactgtgccataaaacgttgcatcatctgtcgcatcgccggccgctgttttgccgcttgcgtcaggtggtaacgcacttgcataaaaattcgctaaccatttctggcataatcgcccgcttctcctgggcctgacgtcgttgctttaattgtcgtaaccgtttctgtttactgacttttgcataatgtccttgcttgaccatcgtgccaccacttttcctgataattatattgatacctaattttaacgcaataaaagcccaaaataaaagcacttaccatttactggcaagtactcttgattacaacgtttcttccttgttaccggcgtatttacggaaataaatcaatgtcatgatgaccagaaatacaacaccgactaaaattgagtagcgcgtttccggattaataaacatgaagaccagtgttaacgcgaggaaggccaacgttaaataatttgaatagggtgataatggcattttaaaaggatggttcgccatcttggctgcgttttgcttacggaacgcaatttgactcactagaataacaaaccacggtaccataccgggcaagacactcgatcgaaactgtaaaccatcacgaaaatctcgctagcgtccttgaaaaacattggtaatacaacattcaagacgactccaattagaatcccggtcgcaatcgcaataacggaataaaatggtactccatgacgatttaataaagtcatcttccttggtaactggtgactttccgccaacgtgtaagtcattcgactcgcactataaattccagaatttgttcccgataaggaagccgtaataaccacgaagttgataatcgaagccgcagcggtaatcccaattttggcaaatgtctgtacaaacggtgaaccaatctggcttaacttatcccaggggtaaatgctgacaattacgaagatggcacccacgtaaaagattaaaatccgggcaaccgttgaacgaatcgctttaacgatcgtgctttgtggattttcagcttcaccagctgtgactccaatcaattcaatcccttgatacgacgccaacacaattgctagtgcgaagacaaagcccttcaccccaccagtgaagaaaccaccatgggtccacaggttactgattccaattggatgaccgccgttaccaataccaaaaataatcagacctaaaccggcaataatcatcagaataatcgtcaccactttaataagtgagaaccaggtttccagcgtcccaaacattttaaccgagataaggttggccgcacataagaatacaatggcaattaggcccggaatccagtctggcaagttcggccaccaataccggcagtagccgcctagtgcaatcatttcactcatcccaacaacgacgaactgaaaaatgttgctccaagccgtcaagtatccaaaaacggggtgaatatattcagaagcaaacttggcaaacgaaccggtattcggatcgacatacagcatctcacctagtgcccgcataatcaggtatagaaaggcccctgatacgatgtacgcaattagcactgacggcccggtccacttgatctggttgagctggatcccataaataggcccactccgatcgtgccgcccagtgcaatcatttgcatctggcccgtacttaattttctctgcataaattactctcttttcataaaatcaaagaactcacactatcacggctgacagtatatagcttttatcttagctaaaaaagtgcaccgacgcaaacggatttagtgacacatagtcagtatgtacttgctctaacgcggttcgagcatgcttcgtataaatttatcaacaaacagctttcagtcagaattatcggtataataagggtaattaaactagaaacgaggtttcgtcatggcaaattacattaaagaaattcgggctttggttgggcacaaaccaatcattttgaatacggccgctggtattttagtcaacgatcagcaacaagtcttgctgaaccttcgtaccgatacgcataactggagtttacccggtggctatctagaatacggtgagacgtatgccacggctttgcgtgcgggaatataaggaagatagtggcattgatgtcgaagttgttgatcgcatcggtatctttgataaaggcgagacggcctatcctaacggcgatgtagctcaaacaatcagtgcactctttcttgtaaaacccattggcggccacgttctgacccaagccactgatgaaacactcaaactcgactactttgatttcgacaacttgccgccattgttaaatcaacaaaatgcagatatgattcacgccgcccaggaatatttacagacccattcggcaaccaaataacctaaccaaaaatcccactgagtttaaagcctcagcgggattttttatcgaattcaatctggcttgtatcacgaatacttataagtcgtaagcaaattaatttttgactgttcgttcaaaaatcgtcattccacccatgtaaaaatatgcgtaaccaatccggactttccgtctccggtgttgtctggggatgctccggatcgggcaataatcgcgatacgagcaattgccgtcagcggcacctgttggatttcaaacgtttcgtaattgtaaagcgctaagcaacccactaattgtgcatcatcctcatccttagtcgtggtgctaaataattgaatcggataaataacctggtcgaccatccctacagtcggctggtaatagtgcatggtcgtcaactcatgatacgtgactgcatgaatcaacgcctgtaacaaggtctcgttgacaccttccgtactacccgcaactagctgaacatgacgctgataattcgccagcgcatgatacgtctgatcacctaacgtctgccgcaatttttctaccgttatcgttgtcacacttggttctaggcgttgaccaccctgataatttggtaatgcggagactaacaaggctgccaactcttgctgcgtaaacgtcgcgttggtgcgactaggtgttactggatggtaaggaactagcggttgtgaggagaagtgccaatgctaatttcagtgctggttgtacgcgcggatcaccaaacggcgcccagctgaccatgaagccggcctgcatatgtgcactaacctggccaactcggtaaataaccgcgggttgcgcagcatcatcgaccaagttatcattcagccccgtcttggtttgagcactgataccaaccacataaaagctactagcgttcgttaagaccgctgctgaaatgtgttcattttgccaccgctgaaccacgtcggccttcgccgtcacttgacaagtaatgaggctgtccggcggcacttgtgaccaatcaggcgttaatagataacgtttggtgacgtgtaattcatcagcgggcgtcaaccatggcgataacggaacccgctgatacttaatcgggtgaccattgcacatcatgacaattgttcctaacggtgtctgtaacgaatgcgttggcaccgcccctaaatttgtcctcggcttagccaatcgttggcggatttgcaaacgcctcaatcggacttgggactgcagtagtccgccatagcatcaattcaagatgctgtttttgttgatctaataccgtcacgatgccgtacaatcgttgtccctgatccatcagtgccgcgtacggctgattctgataccgggcaatgtagtctaacttagcatgttgcaacgtccacactgagatggcattatcatcgtattgattgccactttctcgctggagcaacaccgccatacccactctgagcgtcgttaacgttgccacaatatcatcgacataccgttcgccaacgaccgtgactgtatccaatgcgacggctgcatcgctcgctgaattttgttcagttacttgaacaactgtggtcactggaattatttcaatgtcagctgtttctggttcgtgggcgcgaactaacagttcttgcccctgattaatcacagcgataacccgataggtctgcttcttcaacgtcattacgctcatgccagcttcaaagtttcgttccatagcggtcaccccttaacaataactttattccattatacgaaagcgttgccagtattaacagctttacgaattgttttacacgtcagcttacaatatcttggattagttatctagttgccaacaccatttcagatgtttcacgcgaaacattcattagttttgcggctgcacattaaaaacgtggttatcctacaattcagaataaccacgcccaattttatcaatttgctagtcaatgctatctacgccacacaagcccgcataaacgccgcaaacaaccgcgcccgcacggagtttacttgttgcatcatttctggatgccactggacacccaactgtagaccaccagctgtcgcctcaattgcttcaacaacctgatccgcactttgggccaccacctgaaagcccgttgccacttgtttcacggcctgatgatgaaatgaattgaccgtgattgcgtcactagtggtgcctaaatattcagccaaaggtcgtacctggtacgaccttcacgtgatgcatgccgtaagcggccaattgtccttgcatatgttttaaggtaccctgaccagctggtagttcactcatatcctgataaagattgccaccatagcacacgtttaagatttgtaagccccgacagataccgagcaccggtttaccaacggcgtgggtggcacgaatcagcgcaatttcatactgatcccgttccggatctaccccacccaatttaggctggggttcctccccatacgtcaatggggccacatctgcaccaccacaaagtagtagaccatcgatcattccaacgtatcgttcaatcgtcgttgcgtcggtcgttaccggtaataccaatggcacaccgccattatccgttactgatttcaaataatcacgattcacataatcacggacccgccccgggaacatctggctgttcactgtcacaacgcctggtgcgattccaattatcggtttaaccattctgttcgcgccctctctcaaaaaaatcccacggtaacatgcgtattaccaatgggattatcatttactttttacatctaattgtcaatgactaagctcgcgatattcgagctcggttggtttgacgataattcccgtcaaccagacggcgatgctcagcccaaccaatactaatagcgtcgtgccaccaatgaaatcaatggcctgtaactgataataggcgacaatccccacaacccaccagcaaaagttcaaccagtatggtaacgtagcgtgccgcacaaagtacgtgacgaagataatagcatatagcggtgtgaagaccgaaccaatcaaatacaggaagttctgataatacgtcatggcaaccgtcagcgcaatcaatagcccaactaccgtcacaccaacggctaatcgattaacatagcggctaccggtcagattagccaaactcgtggcggccgaataagtatctaaaaatgtcgtcgtcaccgttgagaaaacaaataatcagcaatgcaaccaatcctaaaccggaccgcgtcagcaatgccgtgatatcagtttgccctgtccgtaacacaactaatagccccgtcacaaacatcactaaactgcctaacatatagccacccgcgctgactagtgcgactggtaaaggacgatcaacacgctgggtataatcaccaattagtggcaaccatgagagtgccatcgtaacgttcaattccactgcttgcccaaacgtcatactagtcgttgataccgactgactagttgtcggtgccataaataccattacgagcattaacaccgtcccgagcaccaacaagcccacaacggcattgttgattttgaacagtaactgactacccatgagcaaccacgcaataatcaaaatcgccacgatggttgccattaatagcggacttcgaaaaccaaatagctttccactaatactgttcatggctaactgagcattgacgatcatcaccgccgtccaagccaacgagttgcaaggcgttgagtcctgacgctagtaacaccccgccgcgaccaaaagccagttgggctgacgctaacgcggactggtgtaatttagcccccaaatagccggctggaaccaagaacaggccacagccgatcaagtgccccaatacaatcgcagccaatccgcgtgtcagccccagtggtgccatcagcgtacctgttaagatttcggcaattgagatagccgcaccgagccacagtaaaaattggctccgaaaaatcccgtcatgtttcatcagtgaccctccgtagccgttagcatcgccttgaccgtggcagccatatcgggactacgcgttaacattgagatcaccgcagcgccagccgcaccagtagccgcaatagctggcaattgcgcgacagtaattccgccaatggcgacaacgggacaggttgcagtcacgactaattgtcgcaagcccgtcagaccgactactggatccgcatcggccttctagatgtcgttggaaagatgggaccactaccaagataggcaatgccttccaattggttagcaatctgcacttcagctaaggttgaacaagacaaaccgacaaacatttgattagcgacccgttgaataacttgtgtcacccggtcgtccttttgaccaacgtgaatcccatctgcttgcagtgcgagtgccagctcgacatcatcatcgacgataaagggaacatgcgcttgcgcacagcgttcccgcagctgctgccccaatgcaaaacgctcagccgtagtcaactggctattgcctttatctcggtattgaaatgccgtgatgctcgcatccaaggccgtttggacgaccacattcagatcctgtcccggcacgtcttgtgtcccgcacacaaaataagcacgtaattgtgtgggttcaaatttaagcgtcatgaacgatcaccgctcacttggggttgcccaatgattcaacgggccatgaccatgcccgacctggataccatcctgaatcgtcccagcaacgtacgccttagccgttttaatggccgcagccattgaccgtccttttgctaattcggcggtaatacatgccgatagagtatctcccgtgccgtgggtccgcaccgtatcaatccgtggagccgaaagccaaaaggcggtcccgtcagccaacaatacgaagtcattagctaaatcaggattatcaccatgcccacctttaataatgacattgtcagcacctaacccctgtagcgcatgtccagctgtaaccatcgcttgattactagtgattgcctgaccggttaatcgttctgcttccggtaaattcggtgtcacaacagtcgctaacgggatcagttcgtcgcgaaccgttttaatcgcatccgcggctaataacgccgccccgcctttcgcaatcatgactggatcaactgtcagcggcccaaaatcaactcgtttcaagttctcaacgacggcatggacatgttcagtcatctgcaagcatccccgttttacaagcgcgaatgtctaagtcagctgctaacgaagcaaattgttcgtcaatgagcttcgtcggcattgccataaaatcttggacccccaatgtattttgagctgtcacggcaacgactaccgcggtaccaaaaacgtgacgtgcctgcatcgtttttaaatcggccatgacaccggcaccgccaccactgtccgtaccagcaatcgttgccacttgtggaaattcattcattaaatctcgcgacccttcattatatttaatcaactttagcaattgtttgaatttctgacactgtcactaagctcagccggtcaatcaaatcaatggcaaatgtggcgggacgatcggccgtcagctgactggcgacaagttcccccgctcccgctaagactaagcaagccatttgcgccgcctggtaaatatcggttggactaacggctgtaaaagccgcgacgatactagaaagtaaatcgcccttagagcccacgtgacgttggaaaagcggggtaccattagcgactttaacaacgcgccgaccatccgtaataacatcagtaggtcccgacaatatgacacagcattgaaattgctgtgcacaagcttgagcaatttcaaccaggtcgccctgaccgctccccgcatcaatgcctttcgcttgccaatccatgccagccaatgccgcaatttcaccagcattgccccgaataacatcgacttgaaaatcagatagtaatgctagcgcgacttcttttcgataagggaccgccccgacggccaccggatcaagaacgactggcttatgatactgattagcaagcttaccaaccactcgcatttgatcaatctgggtggtggtcaaggttcctaaattaatgcaaactgccccggcaatttggaccatcgtctctgcttcttggacttcagctgacataattggcgaggcccctaacgcgtttagcccattggcaacgtcttgaactcgtaacaaaattggcaatgttaaaaacaatcggattgtgatcccgtaaagtattcaataattgtaattccatagcaattctcctcctcattgaccgtcacaccaatcaaaaacgaccaccaatcaacatgcattgatccagtggccgctaacattagctgtgacactttcctacgcaagtttgagcttacaggttcagagggatcggcacttacagcaccatctcagcccatttttggacacccctagtgtttaaaaatattcaattactaaccttagtctaacgattgtaaccgctaacgtcaatctttccgttagccgaatcaccctcattgctacttaattaattaggcattaaagtttaaattcaccgccgcgaccggttataataaaaagcaaatatgcctttaagaaaagagtgattgaagatgcaagcacttgttgtgccagatccatccgctcaaactatgaaacagcttcaatggcaagaacggcccatgccccaacctcgggccaactgaggtgttgatcaagacccaagcagtcgggctcaatccggtagattttaaattagttacggcgggtaacgccgcctggcaatatccacacacactaggactagacacagctggaatcgtggaagcggttggcgctgaggtcactaattttcggcctggcgaacgagtttgtgggcacgctaatctcgccaataatgggacgtttgccgaatacgtgagtttaccagcagccgtgctagctaagattccaacgactgtgagctttgaagcagccgccgctagtctctgcgctggattgacggcttatcaggccctccgcgcaaagccaatttaaatgccgcgcaaactgtgctgatccatgcaggtgcgggcggtgtaggcagtatggctattcaactcgctaaggctgctggcaagaccgtcttcacgaccgtttcacaggccaagcaagccttcgtggcaccgctgcatcccgatgcccaaatcgattaccatcatgaagatgtgaccacatgcattcaagacctaacgcagcagcacggtgttgatctgatcattaataccattggtcatgctgatgcggacttaccgcgcttagcttacaatggccagcttgtctgtgtattagcaactccggaccactttccaagtaatcaagttgtaactatcagtaaattggacctcggtggtgcccaccgtagcggtaacccagcgcaagttgccgatcttgggcaaatgaccgccgccttattagctttggtccaaactggcaaggtcgacccactaattactcaggtcttgcaccgtgaccaacttgtaagtggtttacaacaactccaagctggtcaagtcgttggtaaactcgtcgtgacttttgacgcctgttgatctaaaaatgaagatacgaaaaacgcagctcaagggcggccttgaactgcgctttttggggtgtcaggcgataatcgcaacatgtgcgtatcggcttggggttacgattatcatcgggtgggcgaatgaaccatgatcaccgccgttcagccgcccatctccgattaatcccgacaccactatcattaatttgattaggcctaggcgaaagtggccaattgtgccttggtcaacgtatcattcatccgaccactacggaagccacctaaatcaagggtaacgtagcggaatccaagtgattgtaattgacggttaacgcggtcgttaaagactaagaaatcaccaattcgtgcttctggtaattcgatccgcgcaatatcattgtggaaacgaacccggaccgttggaaaacctaaactacgcaaatatttttcggcggccattacttgagcaatattgtcatgtgtcaacgtcgtcccgtatgggaaccgtgaagatacagagcatgacgccactttattccagttcgtcaaaccgagttcttgtgccaaggcccgaacgtcagtcttgaagaaatcagcttcttgtaacaagctcccgggcccccgcttcactacgggccttcaaaccaggacgataatcattttcatcattcttgatcataccgtctaagacagcggcactaccgttattagccgcaatgtcattcaaccggctgtagaacatcttcttcgcatagtaccagctatcaggcgtgttgttcttgatgtggtcatcgctcaagtagtctagcgtagttccttgaacgttagcacctagttcttcggctaaactcatcgctttatcgaattcttcatccgtaaataattcagagttcgcaaccacagcggtcacattgtcacggcctaaaacatcgagggccatcttcaaaactaaggtactgtcgatcccaccagaaaaggccacggtgacccgttgtaaatcctttaatgctgctactaacgttgcttttttgttgctaatgttgccataataaaacccttcttctatttaatttaattaattccaaaaaagccatgcataaaccaagcggcaattttgctgccccgacaaagggcgcaattcctggcacaatgataccgtattgccaatcactatcggctttattggcaattggtaagatggcgtgggcaatccggggccccatatctcgagctaagttcattgcgaacccagttggaccaccaagtcccatcccaatggcccatacaagtaggccaacgccaattggcacgattcccggcgttttaatctcagaaatcgctaaaatacccgaaataaaaataaatgtatcaaataattccacaaagaaattccgcggtaagttacgaacggctggtgccgtacagaataagttccgaattgtaatgggtgaaatctcatctgttgaggctttaaaatgatcagcatacatgatccaaacgatcactgagcccacgaccccaccaagcacttccgcaacggaatacggaataaataaagaccatgcgatatttcctaatagacactgcgccaaaaccattgccgggttaatgcaacaacattgccaaaaatgaataaggcaacgctaatcccaaaaccccaagttgtaatggcaaaaatatgaccggaaccccgatacttggttccctttaatacggaactacaatgaacacccaccccaaaaataatcattagggctgtgcccataaattcagcaatcaactgatgtaccaaaaattacgcctcctcatctaattgatctaccgccactaaggctgcctggtagaccgttctaaacggaatatgaaattgctgcgccagctgggcacaatccgcatattccggcatcttcttctcaatatcttgatatgtcgccactttaacttgaacgtcaccgtacggcgttgcgaccgtcaggaagtgccgttgcataatagtacgttgccacgtctggtaacgtacaccaatcgtcgtcgtttcttgtaaaatcaacttagtcagtaagtccttatcgttaacgtttcccaaaaccgttaactttgtcgccggccgatcttgtcttcatctgaatgggcgtgaaaaacacatcgtatgcgcccgccgttaataactggttcatcacgtaccccagtccttcacccgtctgatcatccagattagcttcaatcattaagacagcatcagccgtccggttaacgatttgctgacttagtttttttttcgaataatacggctcgcagtgcattgaaaccacccgtgtcccgtttaccaaacccataaccaactctagttggcacggcattttccggtaacggtccgaattcacgtacgagcgtcttgaccaagcccatcccagtgggggtaatcaattcagtatgcacatccaaccgttgttgaatcggaatggcactaccaactcgcatctgcatcacggctggtacgggaactggcatctgaccatgggcaacgttaataaaaccactaccatcacttaacggtgaagccatgatggtatcaatctgcatcaattccaacccaatacagcagcccacaattatcaacaatcgaatccaacgcgcccacttcatggaaatgaacttcagctagtggcatgtgatgaaccgctgcttccgcttgcgcaatttccataaagatcgctttcgcgtggtgtttcacggtatctgataagtcactgccgtcaattaacgcctcaatatcagctaaatgacgcgcttcatgatcatgatgatgcccagcttcatgctgatgatggtgatgttccacaaaaccatggtccttaccacccgcaacctgaacatcaaagctcgtgccatagatgctactctgggcttcccgttgctgcgttaattcataaccgtgcacgtgtaacttagccaattcggtttttaattgctcaaaatcaagtcctaaatcgagtaacgcgcccagaaacatatcaccgctaatccccgaaaaagcgtctaaataaagtgtttgcatttatcttctccttgttcagttaactgaatcttacatttgattgatcatactagctgagagtaggcggcaccaaagccgttatcaatgttgacaacggtaatccccgacgcacagctattgagcatggtcaatagcgcggtcataccttgaaaactagtaccataaccaacgctggtcggcactgcaatcacgggcttatcaactagtccaccaacgacactggccagcgcaccttccatgcccgcaatcacaatgaccacccgggcaccacgaatcacatccaacttggcaaacagtcggtggattcccgcaacacccacgtcatagactcgttcaacacgattgccaaaagtttccgcggttactgctgcttcttcagcaaccggttgatcggaggtccccgccgtcaccacagcaatgtaccctggtgttttcggtgcgggttgttccccgaccgtcatacactgcgcagtggcatgatagacagccgttggtaacgctggttggagtgccgcgaatttttctgcggataaccgggtcgttaaaatcggcaacagtctgttgggacaaggcttgcacgatacccacaatttgggttgccgtcttaccagcaccgtagatgacctcaggaaagccattgcggcgttgacgatctaaatcgacattggcaaaacctaatgccgctgttttgcccgcttctaactgttgggcagccgccgtcggacttaattgccccgccgccacttgttgtaatatttctgctgtggttgccatactacttcacaataacgcctaaaccatcaggaataaccgtcactttagcggcttgaccctcgcgcgcataggccttttccatggcttcatctaacgtcttggccagttccatatgcatattcgtaatcaaatcaggatcaacgaggtctgacacaaaaatcacgtgatgatgaactaagattcgagcaaagatttgggccgtccattggtcaggaatagttttaagccgtggcgtgttgattgcttggtccaggaattccttaggatcatcaacgtcagctaagttgtgataaaacccttcaccaccgtgaccatcacgagcaccggcaaccataataatcgtgccgccttctttgtttgttgcttcagcagcggtcattcctttaacggcctgataaatattttgatcaagcggataaccaccattcgtcgaaatcgcaatgtcacaatcaatggctggtacactagaaagttctttgacaaagtcacagcccactttatgggaggcttccatgtcaccggcaaatgacccaatgatttttttatcttcgtctaaaacaacattgataataaaggcaagtttagcggtccgagcagcgtacaccatatccttatgaatcggattatgcattaaattaccggtccgggccttcggtgagttaataaattcgccggaatggttcgccataatcgtcttgtatgaagcaatcccaggtaaaacggacttccgaccacctgaaaaaccagcaaagaaatgtgattcgataaagccttcggagattagcaaatctgcttcagcagcgaccttattaataatgcaatcgccgccagatggtaattggccaatcttgaccatactactgtcatcggttgagacatgcatcacgatttcttcgttattgacgatgtcttcaccatacttattcaccaattcttcgtgggttgatggccgatggaaaccagtagctacgaggatccgaatccgtgcatcgggcgccactgaccgtaaccgccgcaacaggatcggggtgataatatgtgaaggaactgggcgcgtgtgatcggaactaataatcacaatattgtgcttcccacgagcaagttcctccagcttatcggagccgattggattatccagcgacttctcgaccgtttcctgttctgataatttgttatgatatgttgcagcttgcgacactaacttaccggcgtaattttcatcatcaatctgagccttaattgtgcgcttgtcatatggtaaatcaattgcaaccatgacacttttagccatcctctttctctaaaaactaatttttacatgcacgttttgttatactagaagacggataacttgtccgttacattttaagttttcaaaaatagttaacaaatgtatactttaaatgcgattgtcacaatcatgaaaaccgctatgcttaagtagcgttatcgtcgtgattactgttgagaatcgctatttttactgacctcaaccttaaaaattattcacgaaagaactgaaaaactaagatggtattaactgatattgaatatttactaagttatttggaagcccatcacgtgccgacaatcaaaaaaaagcggcatacttacctgacctatcatggtttagccgaacactatacgtacgtcttaaaggacggcatcatcaaaaacagcattattttacaagacggtcgcgaatataatttatcttatattgccaagcccgacgtgatctccccgctgcgtgatgaagtttctcgttctacggatcaaaccgtttaacgtccgtattgagtccgaatacgccactttttatcaggtcaaccgggtcgctttttggaagtacgtcaacagcacgcctgaactgcaaaactacgttaaaaattattaccgtaaaaagttgtccgaaaacattcttcgactgcaacggatggtcatgaacggtaaaaaaggggccatttgtgcctttatctatagtcttgttgatttgttcggacgaaaagttaacgaagggattctgattgactttgtggtcaccaatgacgacattgccggtttctgtggtatcagctcccggagcagtgtcaaccggatgctcaaggaattacgaacagacggcgtcattacggtcaaaaatcacaaatttattattcaagatgttagttacctcttagatcaaattgcaaattagtgaggtgctcatccgtgcatattccggataattatttaagtcccgcaacttgcggaacgttggtcaccgcgatggctcccgtctggaccgtcgccgttttaaaagttaaagttcaaatcaaaaacatcatgaaaccccgccaatgctcggcatcgccgcttcattggcttttttaattatgatgttcaacttgccgattccaggtgggaccacggctcacgctgtcggggaaccctgttagctgtcttgattggcccatgggcggcgtgtcttgcgctgaccgtgacgttactactacaagccttattattcggtgatggcggtatcctagcctttggcgctaacgcgttgaatatggcggtcattatgccgtttgtcggctacgcctcgctatcgcctaggtcaaaaatggcaccatgaaaagttggggctcgcaattggtgcttacttaggcattaatatggcggcgctagttgctggtatcgagctcgggttacaacccatactggctcatacggcaagtggtgcgccgctctactgcccatacggcctcaacattacgatacccgcaatgttgacggcctcacttattagtcgccggctgggtcgaagtcgtcttcacactgcttgtctttcaatttgtaaaacgagtcgcaccgactaacctctatcagacacccactcggcgcaatcagcggccgtggatcgcactgctactcggattagcggtgttatcaccattaggcttgttggctagcaatacggcttggggcgaatggagccccaagaattacagcaacggctagcgcaacaacatatcagtactcacgcgcctcaaggaatggtccacgggttccattttcaggccctgttcagtgattacgccatcgcgggcttaccggtcagtgtgggttatattttatcggccattaccgctgttttgattttcttacttttgattcgaggtcttcaacatgaaaccgacacgtcccaacactgatattccagcttggctgcaaactacgaccaccacgccaacaccgctattaaagcgaaattttggcaacgtaatcagcgtcaccattacgccaattactcagtcgactagcacagccagcgccagtcacggcaacgtctcattggcgcgttgcaccgcaattcaaattaattcagctcctgttgctcgtcattttaattgctttaagtaataatctcattctgttatggggcctagcactattagttgggtgccaattattatggttacctccacgccaactgcgccgttttatgggaagctggctaatcagtgttgggatggccatgctgttcgtattaccgagctactggttagccggtcccaccacgttattattctttggccttaaaaccagtctaatgctggcaaacgctcaatattaccgtctaaccacgccgtttcaagatttattggctggcttgaaggcactccattgccctgatctattaattatgactttggccattgccatcacgtacttacgaatgctcggccaacatctattgctgacgatggaagcactagaattgcggacggtcgccccaacggctcatccataccgtttaatcggcgcattatttggtaatttatatcttaaaagttacacttatgcgctagaactatacgctgccatggaagcacgcgggttcaatggtcattacgcgcgctcaaccgggcgtcgtacccattggcgcgattatcttgccctgagcccagcgattattgtctggatattatttattttttggaggcattaacgtggtattgattaaattggtgaatatttgctatgattatcctgatacgtgtggcttgaaggacctcagcttaacggtcaactcaggcgactttgtctgtctaatggggcccaatggatctggtaaatcgacccttttacgactattgagtggattagctagtccaactagtggcacttatcagtttcacgatcagccgattacgaccacttatctcgctgatgcccaaaatcgacaacaacttcatcagcaaatcggcatggtctttcaaaatactgatgtttcaactattcaacacgtcggtcactgaggaagtcgctttcggtccccgacaactcggtttatcagcagccatggttgcgcaacgcgtcgccgactgcttacaattaacggactgtgctaacttagcagaccgggtcccttaccaactttcaggtggtgaaaagaagcgcgtggcactagccagcgttctcgccttgaaccctgaaattttattgttagatgaaccgctgaacggcttaacaattgccgctcagcagcaaatgctaaccctactgcaacggctacaagctgccggcaaaactatcatcatggcaagccataactaccagcaagtccaagccgttggtgaacgtttcattatttttaacagtacccaccaagtcgacgctgacctaacgcgcgctgatcttgatcagcaacccgctcggcaagcgcaattgatgactttataattaagaggagttgagaagagatgcttaatccaaatactgagattcatcgtgggttggaaccggcgcgttgtgaccggtaagactttagctgaatgtgatgaacgtttagtgaagtatttaaacgaccaagattatggttctggtgaattcgttgttttacacgaaaatgacggtagcaacgaaaacactggctatgatttacctgatggcgataactgctacattagtttcttgatttataacagccgactttaagttggtggtgacaaaaatgcttactggtggatgatcgccagtaagcatttttgttaaactcacaaactattctgattttaagcccaactcggctaacatgattcgtgcaaacgccactaagtttggacgtgaccatcgtataacctgttcgtcctgttgaccagcataggctgctaacgcccgcctgatcaacggatgccactgtgttggcagctgttgtaacccccattcacccccggcccgcttagaaataattaactgatcttgctggtaagcgcgaactcgacaaaggttataataccgtatacattggtaactgaacgatcgccgtttcagcattcgcgatatcagacttgatactgtcccagtaggccaccgcgtgaatggggccaaagaccgttgtaatggctggtccaagcaagacttgtcccgctgcttggagaattgttaagtgggcagtaagatcaggatcagtaccgtgcatcgtctttaggtaggccagcggtgcctgttgataatgctcataatggtattttgaaaaatgaaaatcgaatgggcaaggatgcgcaaaatgctgagttgcactcagtaacagcacgtgaaactcaatcccttgtgtggcgctaatggccacaattgcgttatggtagctgtcattaactgccgtttttcagctaatgttaacggacgccgagcaacgatcagatagtctaaatcgctcacctgttcgttatatgagcctaaaacataggatccatgcgggtaaataccaacaaggtttgtttttaaaattgcgagtgcggtggtcgtttgttgaatggcttgtaataaccgtggtgtcgatgtcatcatcaaaccactccccctctaagtcttgagcttagcgatagccacgaagatgcttaatcaaccacgcttcgtcgaaaagtttttcccaatcacgttcgatagaaatattgccagtttgtttgataaatgagcgatgctgataagtttctaataacatattttctcccgtgaagatgtgttacggttcgtgcgtatcatatcatacaacgcactaaagaaaataacggactgccaagtgccagttgtttcacgtgaaacatcctacttcaaataaacacgagtcagcgcttcgcacaatttttcattacactcttgagcgttatgaatggtctgcaaaacttgctgctcgtcaccttgtggttgtgttaacaccacccacacgtcaacgttcgcttgatgaacatcatcactcaaatgtgtcggcaaagccgttgaactttgcggtgtgggtagattaatttgttgtaacgttaaaccaagttgatcaattgccttaattagcgccgccactggtgcttgcattggttctgccaacgtctcacttaactgtcgaaagccaccgctatctcctagtgcccagttgccactaaagccaaccgcgtcgatagggtcatccgtccgacgataagtcacatatcgaaccggcatcggtccctgagccaaaagtccgggcatcgcttccaagttcgcattgatctcagctaaaggtaattcccggaaatcatggccgactagttcgtaacgaccaccaaccaattgataatcaactagtcccatcgccttaatcaggccagcttgcactttgaaaccatcgtaaccaacttttaacgcatcgaacacatcaatcgcttgcgcgtcggttcgaaaaccaaagtttagccccgccccttctggataaacgagattacattgatactgaaacgacatgccgattacacctaagtcttgattggcccgcttcgcttcatcactaaattcaccgaaataaccggctacaactctaaagctcatgtttagccctccttaatcttgtcaccgcaatattgaacccgtttacattattgatgtcattataatttttattcgcgcataatgaaagtaattaatgcttgcagccgttattaaaaaccacgcaatcaatgccactcgacactatattaatcctcggtttatttacgaacatcgttttctgtttgactaaatttatagttgaacaatatttttccagctcttgacaactgattttcaaaagcggtatactcacttcaacaaaatatcgtccttataaaccaatgaggtggagatcaagattatcgtgcccgcacagagagtcatcgttgctgagagtatggccgaacgcgggtaattaaatggaccaccgagggctttgccgaaattaacgtcagttgagagtacggaaagacgtgcgacatacgtcagttgtcagggaaatgttagtttcctatggagtaggagtgtacgcgtgattaaatcactaaattggcgaacactcaattaaggtggcaccgcggttatcaaaccgtccttaacacagcattggctggataaggacggtttttttgacgataaaaacggggtgaaataaatggtcacgaaacgatggcaaaactcatggatcaaactaaccaaatacaattatacttttggaggatttaattatgagtttatccggaacacacaaattaattttaacaatcggcagcgtggccattattggcggcatcggctttaccgtcaacgcccactcacacccagctacgactaaacaatcacaagttatcaacctatcagctggctcagaaattatgagcttagatcccgctaaaatgacggacagcgtttctaatagccaagtcacccaagttgacgaggggctctatcggctgaacagtcagagccaacccgtcaacgctttggctactactaaagacaactgttaccaatggtggtcatacctatatcattcaattacgccacgatgcgcgctggagtaacggtaacagggtgaccgctcacgattttgtctattcatggagacgaactcttgatccaaaaagtaaatctgaattcacctatgtcttcacgaacattaaaaatgctgacgccattgcagccggcaagaaaaagccatcaacccttggtgtcaaagctaatggtgactatcaattaacaatcacgttaagcaaacctgtcgcctactttaaaaagattttagctgtttcgaccttttatccggtcaatcaacccgctgttaacaaatacgggaagaagtacgggacttcggccgcgacgaccgtctacaacgggccatttacgcttactggctggaccgggactaataatacgtggaccttaaagaaaaatccagcttattacgatcacaaactggtgaaactgcaccaaatcaattatcaggttattaagtcccaacaatacgactgcctgcctataatttatatcaatctaataagttatatagtgtgacacttaatggcgagcagagtgtccagaataaaaataatcaagaactcaaaacacttgcgggtggtcaaatcagctttattcaatacaatcaccataaccatgtagcagccaaccgtgaactccgcaccgctttatccttagcaatcaaccggtcgcaactgaccaacaaagttctagaaaatggttcgcttccagccaaaagctttggtgtgcgcaatatggctaagaatcctaaaactggtaccgattttgtcaatgatgcgaccgttgatggtactgttaattataatctcaaccaggctcgagccgcctatcataaagcacaacgacaattgggcaaaaaatcgctaacgttaacgattacttgtggtgatgctgacaactcacatcaggtcgctgaattcatccagggacaattaaccagtcacctccccggactaaaggtaacaatcaaggcaatgccatttaccgcaatgctaggtaaagtttccaagggagccttccagcttaatttaactagctggagtatggattttgccgacccttcacaatcattaacaattttgactggcgacagcaactccaacatgggccactatcaaagcaaggcttacgaccaggcaatgcaagccgctgatggtccagatgctttgaacgcgaccaagcgctatcaagacttagttcaagccgctaaaacggcgctaactgatcaggccgtgaccccactctacgaaggccgttcccatctgctcgttaagtcgcacttaaagggcgtcatctataataatttcagcggtgccgccaattatcggaccgcatatgtgaaataacgcctcatatgttgctcctaaaattacccgaccaaaaagcgtttcaagaccgtagcttaacctaagccggccttgaaacgcttttagtataggaatccagtgttaattaaaagtcagtgtttgcttctcgccaccaacacccgcgtcaacaaaaagatcagttagttttaattcaaaaacaacgagtgtcgatccaatagcatcccagacttgttgataattcggaactgtttctaaatattggggtagcaagtcagtcatcgtcttagttgaccgttgtaacttaacgtgttgggctcgtagatatggattgcccgctgttccatcattaggaatcgtaatgaatgcaatatccggattctggtcataaaccttcaaagcgggacttgtcttaactgatgagaagtatagcgtatctggttgtgcttcgtaccagacaaagttaacaattttaacatctgcttcattattgacggccgtgctgagggcaatcttattagttgattgaaccacttgttttaatagtgaaatatccataccgacaaactccttttactcaattagtatcataatttcattataccgcaattgatagttttaggaacgtacgtttgatctaatgtgctatcatatttctatagcttagtttttgctttaaatgctatcaacattatttataaactgaacgcttcgaaagtagtgaccttatgaaaatcatcattgcacctgcgaaaaaaatgattatcgaccaagatgcctttccagccctaactgaaccaatctatcttgatcagacgcaacaattactggctcaactgcaacacctcacctatcctgaggccaagaccttatggcattgcagtgacaaactagcccaacctaattatgattggcttcaaaaaattgacctgacccgcaatctgactcccgctattctcagttacagcggtattcagtaccgttacatggccccggacgtctttacccaaccagcccttgactatattcaggcaaacttacgaatcttgtcaggtttttatggcattctccgaccgtttgatggtatcgttccttatcggttagaaatgcaagcacggttggctgttggtcaagcccaagaacctctatgcgttttggggcgaccgcctctatcaggcactgactccgcggccagaaccaattatcaatcttgcttctcaagaatatgctaagaccattgcaccttatctggctccgcatcaatcaatgattgatattgtctttgcaagccttatcgacggcaaactcaagactaaagccacattagctaagatggcacgtggggccatggtccgttttttggctgaacatcaaatcgatgatgtgacggccattcgcacatttgaccatcccgattatcaatttgacgagaagcgctcgacggccaatcgattcgtctttatctatcaacattaaacatcatcacagcaatcaccaaagcgcccgcagaaggctaacttccacaggcgctttggtctactttaaaccttttaataatcattatagtgacagccaaacaaaatcagatcacgccgataaacttctcaatctagctattcagcaaattatttcccgggcaaaatgattacgctcatttctctaatcatgggctgctagccagtgacgcaatcgcgtcatataggtcgtgttttcatcgataaacgccatgtgacggctacggggaaataacgtccaagtcgcatgaggtaactggtcgaccatggtcttagcgactaatggcgtacacaaatcatccgttccactggtgactaaagttggcatctgcaaatactgtaatcggtcggtatactcataatccgccaacgtaccagtcggattatattcattgggaccccacgctacattataagccgtggtccccacccgttttgatcgccgtaggaattcaggatcatcagcagtaatcgggcccgacgcatgttgcgtcataaaatgttgattagcagtcaggtaggcagcacctgtgaaatcctgtaaccgttctgctgtcgcaatagccgactgatccgctggggacattaaccgaatcatccgatgctgttcctgagcccacagtcggggctgaagacaaggtactggctaaaatcaaacttttaatcccctgtggtcgatagtcacaaccataaataatagctagcataccaccccaggactgccctagtaagtgaatctcgggtaagtctaaatacgtacgtaacgcctgtaactctgccacccacgttgcggcttgccataattgatcgtcatcaggtatcgatgaacgcccacagcctaattgatcatacatgacgattggtcgtcccgtttgaacggccaggtcatcaaatccttcaaagtaattatgcgttgatcctggaccaccatgtagcaaaactaacggtgtcttatttgattgccgatcccctacgattcgataatacgtctgataaccattaaatggcatgtatccttcttgcacgtccaaaatatcactcactttcgttactaattttttacttgttacgcgttatgcgttatgcgttatgctagccgctatttagcattagccttgattaaaaacgtgccaaacagatggattcctgttcgtcagcaatgcgcgtccgattccgacctccggggctgggtgacaattgctggaacgtaagccgacgtcgattagagcccgtgcacaacccgcccagtctcaaatacgagtcttattctaagccggaagcaacccacttccgactaagaataatttggctactgagcattgtcacccagctcctccagtcggtaagccgctcgaatggctgatgaacagccacttaacttggtacaattggtcgctgactattttgatgatggaaccttaaaagaaacgttagggttacattaaccactttgttgagacgttcgattattactatggcgattccgaaatagtgagctatcacaatgtcattttctacctgacagctgctcgacaaaattgctgtttatgaagaacaatgatgagtccaacaaaagttaggtcccttactgtctgccattcgaatactgtcccgactggaaggcgtttctgacaatgcccagtggtgaaatttcacttagcaagcgtcctgtgcttggttagtgaaaggccagtatttgagacgtgggttttcggctcaaatctgtgcccaccacgttccggcaattggcagaaatgcctggaggtcggtgtaggacgcgcactctaagcaagtttacgctaactcgaactgttcccagcgaacctaagctggctgcttttgaatttaaaaaatggcacgttttaatcataatcgatgacaaattaactcgcacaatgcgtacttattccatcccaatactaatgtccacctgaaaaagtgaaaaacttaattccattctaatacaactcaaatgacaatggtgatgtaagcgctacaatagaagtgcagaaataatcagaaacgggtgaataatgatggtattaagtattattacagtattaggaatgggattaattgcagccactggtgtgcactttatcaatggcgcacaagcgatgcacgcagaaacggtcggccatcatgttggtcagatgccggctaaccttcaccaaatcgacttacgttaatctcttaaaaattcacgttaatttttagcattgccgctgaaacactgggcaatgcttttttgtcgttcctttagctgaccgtccttatcagtttggtgcattgagcagcttgacagtcaagcgtatcattaacttatattatctttctgttcgtctagtcacgcttcgaccgaccgttcagagaaggagtgacttatttttatgaatgatttatttgagaaggccccgattcccaaagcgtatttccatttagcctttcctgtggttcttggcatggttgccagcatgatttataacttagcagatacattttttgttgctcaaactggtaatgctgatttagttgctggtattgccctcggcagtccgctattttcgtttatgttagcagttggtgatatttttggcctcggtgggagtgccgttatttcaaagagtccttggccgtcatgattatcaccaaagtgcacgtatcagtagcttttgtttttacattgcgatcgcgcttagcttagtactgacagccttattattactattcgaacaaccagttttaggcttgctaggtgctactgcagctacccgtccctacattgcggacttctatcgtatattggtattaggatcaacctttatcatcgtttcactggttcccggtaacattatccgaacggagggcctggcacaactttccatgattgcgaccatcagtgggacggttctgaccattattctcgatcccttattcttatttggctttcactggggtgcttcgggcgttgcttttgccaacgttttggggtacgcggtcaacaccagtctgttagtctttttatgcgccgagccaaaacgctttccttagcaccaaagttagcccatatctcgcgaccgacccttaaagccgttgtcgcagttggaatcccagcctcactgatcatcctaacctaacccagagttttggcatgatgatcttaaacagctacttagccgcatacggcgcccaagccgtggcggccatgggaatcgttcaaaaagtttacatggtcgttatgatggtcatggtcggctttgcttttggggcccagcctttagttggttacacgtacggtgctaaaaattggcaaagactacgggcaacgttgcgcttcgatttaaaagtcgagggtggctacgcaaccatttgtgcgattattctaatgatttttgcgcctcaacttattaaactatttatgaatcaaccagccattgtcactatgggtacacagatgttgcgagcgatgttgattacgacaccattagtgggtttcatcctcgtgttcacgaccgtctttcaatcagtcggtgcgggtttgagtgccctagccatggctctttcgcggcaagcaatcttactaggtatcgccatcgttattctggcacagttctttggactaactggtattatttgggctcaagcggtcgctgatgtcttaacgtgcttacttggctggttactttatcggcacaccttcaaagatattcaagtgccatcctcaaattaataataacgatatcatgtcgttagctcactgataatcattaaatggcgccatccatttcaagtactggtgattcagtgcgctgaaatgcataagtgaactaaaagctggtacttttggaatgagaggcgtcattccaaaagtaccagcttttttcactctgattcatttttttattcgtctacagactgagtatgggctaaatcggcttctaatgacgcagtgagtgccttcaatagttttagagtcgccgtcatgttagcgcggtaataacgttcagtacctgttttgctaaccgctaaaatgccggcatccagcatcaacttcaaatggtgcgatacggccggccgtgataaggcgatttgcgctgtaatttggttaaccgtcatctgatcagtccgtgcacagcatcaccaaaattcgttgccgattttcgtcttgaagaattgtaaaaatcggaacacccttcttaaatattgccatcgttcgttctgccaaaaatcacacctttccaattacggttcgtattcttaaaccatttaacgcttgctaaaattgaaagtcaagaattaatcgttgactttttgtaagtaagcgactagaatcaacagcatggtttgttcaagatgttaaacatttaaaccaatatgttaggagtccactatgaaagctgccattattactaaatacaagcaaataacccccatggtgacagaagtccctgttccgacaatagctcccaccgatgttctcgtcaaaatcgttgccgccagtgtcaacccaatcgatttgaaaaccaaagatggcgatctaagattgttactacaatacaccatgccactaattatgggcagtgactttgccggtgtaattactgccgttggcgaccaagtaccgggcttttaaagttggtgatgctgtttacggtcgcgcacccaaagatcgaattggaacctttgctgaatttatcgccattgatcatcaagccatcgcactgaaaccagccaatctcaattttgaagaagccgctgcaattccattagtaggtttaaccagttaccaagcactacacgatataatgaacatccagccgggacagaaggttttcattcccggcggttcgggtggtattgggattattgccattcaactggccaaatatctcggcgcttacgtcgcaaccactaccagtgcgaaacattttgacctcgttcaatcactaggtgctgataaaatcattgactatcatcagcaagactttactgatgtattatcccattacgatgccgtattagatactcgtggcgggcaatccctcgaggccgcttttcagattatcaaaccaggcggtcagattgtcagcattgccggactgccaaacgcgcgttttggtaaggattacggactgccaatatggaaacaatggttattgggtctagcaacgcggaaactgagtcaactggaacaacaagcccaagctacctattcgtttctgttcatgcaacctagtggccagcaacttgtacgcctgcgacaactaattgaacaggacgttattaagccagttattgatcggattatcccctcaccgacatcaacgacgcgttagaatactcgcattccggtcatgctaccggtaaaatcattatcagtattcaacctaattagctaacttcaaatcaatctttttaaggagtcatgattaatgaaaaaagttttaattgtcgaaaccaatatcactcgttaccaaggaactaatgagccgactggtctttggttaggtgaagccgctgagttcgtcgatgaaatgcagcaagcccaaattgccgttgactatgttagtcctaatggtggcttcgtgccccttgacccgcgtagtatgaaatataccgatgccgcccacaatggccgtgtatgaagattctgacttcattaatcgggcccttaagaacacgctcaagcctagtcaggtcgatcccgatgattacactgctatttactataccgggggccacggtgtgatgtgggactttccggacaaccctgagttacaagccatcgcactggccatttatcaacatggtggatatgtgacctccgtttgtcacggaattgctggcctcctaaacatcaaagaccaaacgggccaatacttgattgctggcaaaaccattacgggctttaccgcaactgaagagctgattgccggcaaaaacggatcgtccgttccttaaccgtgaacgagctactgctcacggtgctatctttagtcagcatcgattttatcgcgaatatgcaattactgacggccaattgatcactggtcaaaatccgttctcagcacgcgcggtcgcacgccaattgattgctaaactataaaaaaacgagcacaaggctcgcttttttttgcgttaatcttcaaaaatccgctcatgcaaaacaccaaacggcgcatgatcgacataaatctgaccagtgtcgtgaaatccattacgttgataaaaacgctgggccacagcattatttgccagaacaagtagataattctgtggatagaccgcctttaagcgacggtgggcctggattattaattgctgaccaatgccatgatgatgatagttcgggtgaacatatagcgaatacagttcgccccacccctcatagttcgcatgtctggccggaccaaatgtgcaaacacccacaacttcaccatcagccgtcattgccagcaacatattttgccaccgccgttccggccgccaagttgctggcgtcaattgctgtaaataacttgcgggcatcaaatcacgatatgctgattgccaggtctcataatataactgtcgaatttttccaaaatcactgtctgcttcagcgcggacgatccgataggttagtgccatcagcctgaccacctttcaattcaagttgtccctaagtgaggcacatttaatcatttatataaataaggtatccaccaactattcataaagagcatcaattagatgaatgtttcacgtgaaacaaaaacacagtacaaaaatgaatccagtacaacatgttcattttgagtttggtattgacctgaactatggccgaactcgtcgcatatttaacacgtttggcagaattacggccgtaataataatgaccacgccaaccatttgcacccaatcaatagtttcatcaagcagtacaaatgcaacaacaatcgaggctggtaattctaaagaagaaaggattgggccaatgccaagctctaagtacggcataaacaatgaatacataaccagtgggaaaaccattgagaatagtgcaatcagtactccccagccgactgttgctggcgtggtgggtgccgtaactaattgcggtgaccacacgatagcaatgagtatgtaaagcgcccaaacacagtaaccatgttttcgataacgggtctaagttattgcctaagctagccgtaaactgcatcgtgcaagcatacgagcatgccgctaaaaacttaatatcaagccccacggcgagagcgcccgcgtaattggaaacagaccagcagctaaaatcgtgcctatcaataccaaaataatgctaaccacttgcagtcgggagggacgccgatgatgaatcactgctcctagtaatgttgataaccagaccgcccgcatcaacattaccgcggccacagcaactgggataagctttaacgcctgtatgtaaaaggtgttagtaaatcccgaagccgttccagccgaaattaccagtccgatttgcttccaattcgtttgctgattacgcaaacgtgcacggcgtaaaatttgaatcacacctaaaatcacaaccgcactcagaaaggaccagaatagcaatgggccattgacaacccccccgccgacgcgcgtccaattttaaatagtgacgccggaattccaaaactaatggcccctaagccaacgaacaggggcgcaattttcttcacattaatcatcctctcgttgacaagatatgttggagccgggcacgataccaccagtctggcaagcccagtgagtagcgcatcagcatctcaccaataatttgcacaattgggcgtcccggttgtatttggcgttctaacaagctgtcataaaagtcctctggggcactgactaagtgcccgttaagattgacccgtaacggctcattttctaccacgagcgcttgccattcataactatgagcacgctgttcgtcctcagaaacgtcttgtgccaactgtaagtaatgcgcaatatccgctggcaatacttccgataaatccgacaaagtctgtaaagctagacctggccgagttatcacttgacttagcggtaccatcacttgtctcaattgcgcgtctgtgtctgctaactgctgacacaaccagtcgaatcatcgggcatggtagaccaccatactcgtagcacgcccccgctcaacttgagactttaatattaccaacgcttgcttgacaaccgtggcatcggtactgtgtgacatgatagcaagctgtgctggatcatcagttgtcaatcgagttaaatcaccgatttgtaacgacaatggcaaactcaatactggctggtgcaactcatgttgcaaggttaccgcgaacgtcgaattaaacgtcacatccatcatctgactttcctcaatttctattttgatggcgccttaaaatgtgccaattccgtattcgaataaacgtacgggacgtgcgccatctctggcacttgattccaagctaccggataacccgcaccatgtgcgcaaaagaccgagtccggtgtattttctaaatctgctgtggggacatatttggccttatcgacaacagccatctcgttatgacacggccgatagccatccacgatacattccaattcgccccgcccatgcgtgtaagctcgaaccgtctgtgaatagtcccgcatcgctgctactggcgccgttcccgtaattgtcgtcaagtcagtcccgtccgtggctacgcttgtattagcgactggtgcgtcaaactgaccattcatccgctgaatatcagtcatcgcccggccaacttgttcctgaccaacttctagacggaaccgataccacggctccaacaactgacaatcaccacgttgttttaacatcatcaagccttgacgcaacgcgcgccacgtcgcttcacgaaagtcaccaccaaccgaatgaacattgctagcccgaccactaaccagtgttaccttaacatccgttagtggtgcgccaatcaggacacccgcttgtgttttggcttgtaggtttgacacgacttggtgttgccaatttcggccaagcacttccaatgaacaatcggtcgtaaattgaagcccacttccccgcggtgcgggcgtcagcaaacatcaaatgtacttccgcgtagtgtcgtaacggttcaaaatgcccaacaccttcaacagcttgggtaatcgtctcttgatacaagatactccccgttccaaactttacagtcagttgaaaacgatcccgcaagatttgttgcaaaacttccagttgaatcgttcccatgacctgtactcgcaattcctgaagtggttctgaccaagtcacgtgtaattgtggatcctcatcttcaagttgacgcaagactgctaagcgggtgtgtaactcctcacgctgaggatcaagtgcgtaagtcagtacgggctgcatgacgggttgtagactagttgctgcctgtcccaatccttgccccggccgcgttcccgttagaccggtaatggcaccaacggatccgccgtcagcgcggacgtggtcgcatacttagtcccgttgtaaacccgtaactgattgactttttggtcatcatacacgatatctttaggtcgtaaggtgccaccccggtcatccgaatccaagtaagccgttcaccttgatcatcatgcgtaatcttgaacacccgcgcgccaaattcaggacgcgttaattgtggcgtcgtccaataatcaagaccagccattagcgcatcaaccccgtccagcttaagtgccgcgccaaaataacacggaaaaacttcccgccgttgaatcatctgccgaatcgtggcatcacttaacgtccctgtttctaagtaatccgttaacacttcgtcattttgcatcgcaatatcttcaactgccgcagtcggtatgactggccgatcttccaacgtgtccccggctcccggcgtgttaaacgccacacaaccaggcgataatgtctgttgaatttgttgtatcaattggtcgctatccgtccccggcgcatccatcttatttacaaacagaatggtaggaacgtcataacgggctaataatcgccataacgtccgcgtgtaccccgcacaccatcagccgctgaaacgactaaaattgcgacgtccaaaaccgacagtacttgttcagtctgggtcgcaaaatcgacgtggcccggggtatccaagagtgttaaattaatgtctttatattgtaaattagcttggtgtgaaaaaatcgtaataccacgctgttttcaagcacatccgtatctaaaaagcatcgccattatcgacgcgccctaattgccgtagcgcgccagaccggtatagtaatgcttctgacagcgtcgttttaccggcatcgacgtgggcaataattcccgctacaatccgtttcatattgggcttccttcacgattagtgaatcactgcttccagtataccggttctcagcactgaacggctagtaaaggtctgccactaacgttaaatatgcatgaattttggcgtgttttagtccaatgttaatcaccaaaatcaggctagttactttccatagttgcgatcactttaaagtagtggtgacccatttcccgtgcagtagtatcgcaaaaaaaggtatccgtagcctacaactaccgataccttaaaatcattttcagacttaatcataaaaacgctcaaaagctgccttcaggtccattttagcttgctttaatgcctgtgataccgccaccccgttcgtttgcagtccttgtgcacggacaatctcaaaccgatcaaaccccataatttcagtaaacatcttgtcaagatacagccgagaaaattccatgggtgtataacggtcattacgagtatagattgacccactggctcgcagtaacatgacacgataattatcggtcatcaaacccactgatccattttcggtataacgaaaagtctccctggcaactaagatattatcgatatagtcctttaaccgtgccggcacgttgaaattatgcaacggcatcgcaatcacaatccgatgatgagctttaaactgttgtaggagttgctgcttgattgcaaacaggcgttgttcctcaatcgataaatttaccatgttgcgcttgcttttcccagattcccagcaattcaggtaccgttgcttgggaatcaccgtatcatacaaattgatcacatccacagtatcattaggaaagcgagtctgaaaaagttgcaaaaaagcttgttctagttgaactgagtagtgcgccgcattacgaaaatcgggatgtgcattaacaatcaaagtcttagtcatttaaatatctccttaattaataatctatttattggttgtttttgacaacagttatatactacagtcgaaaggtgccaatccatgtcaccattaaaatcatttttaggagttatttatatgaaccgctctgaacgtcttaatcaagaattgatctttctcagttaccgacaagaattccacatcaaagaactcatgcaagaattcaatatctccaaacggaccgccttgcgcgacgttaactcgttagaacaacttggtttgtccatttacgttgaaccgggacgttacggtggtctaccaaatcatgcaacaacaactatgggtacccatcttattaaacagccaggaaattaatgcgctcttttttgcgctcaaagcactcagtttattgtcggcgacccctttgaaaagtcctaccatacaatttacaaaaactcatggcaacactatctttaagcaaccagcgccaggtcgccaaattgcaacgtgtggttaactactactcaattcctaacttggatgccccaacccatttaagtgatttattaacggctatccttgatgaaaatgttgtccagttaacgatgactactgtgacagctgggtttcagatttttgatttattatatcggcatggcatttggtttttcagtggcgtcaatctcgataacaatgcttggggcatctatcgctgtgatacgatcaaagcatttcaaaccagtgagcaaccagctcggtatacttggaaacagctcgcgcaacggcaacggtcctacgatcaccatcatcatggccaatatacgttataaatgtgcactaacacctctaggccgtgaacatgtacaaaagaataattatcctaatatgcacttaacacatcagaacgaccaagattatctcattggtggttataatcaagatgaattagcctatatggtcgactatttactgggacttggccgcaacgttagaattatttatccggaagcgttaaaaactgcctatctgcaagaactgcagcaaattcaagatttctattaacgtttggttttctgaacaaaaatgtcggtagccccgtcaaggactatcgacatttttactaacctgattattctcttcttaactgctttattcagccgtaatataattcaaaattgcattcagaacttgttgattctctcgtggtaccggcgtttgtaaaatttctgctgctgtttggtttaggaccgaccccgcaatataccgataatcattgacgaccatctcacgaacattgtccgcagccggctcaaagtgtgaaattgtaaccccactacccgatgcttccatacgaagccctgattggtcacacgatcactagagaacaacagcgttgcttcggctggaacggtgaacatctcctcgtgccaatgcaagaccgacagttttgctggaatccccggaatcacgggactctgtcggtaaatcggtgcccaacctacttccttagctggcgccttagtgactgggtatcctaaggtcttcgcaatttgttgcgcgccgtaacacgcaccaaacattgggatatcgcggtccaataattgttgaatcaagtctcgttctgcttgatccatggcagcgtatcgttgggactcatcggtccgccgaggataacaagcatctccgtctcatccgccgttgggagaacaccgaattgatacgggtgatagacatacatggtatgaccatgggcatgcgcccaatcagcaatcattccagggccctcattgggggtatgttgcaacacattaattcgccatgattagtcctttccacaacggcaatgtttggtctgggtatcgcccgcaattacccaagatagagtcattataccacgctaattacttgagccatgggcgcttatgttaaacttaaaaccgatcataatttagaggtgataataatggacgtccaatctttttttcgaacaagctaaaacgacgctcaaattgacacagagtaccccattacaaagtgcttatcagtttggcagcgatcctgataaacttgcacagctcgtactaactggcacaaaaacggctaccaccagcgcttatgacctatacgaaactgatgaaccactgccaaaagtgggcgcttatgacgtcatcttagatgctcataatcagcctgtctgtgtgacccggaccgatcaagtcatgattacgccttacttggacatcgatgcaacccacgcttacttagaaggtgaaggcgatcgtacttatgcctattggcgccgtgttcatgatgccttcttttcaagcgggagtaccaaagcgagcatcagcgctttgatccccatactgcacaaatggttctggaacgcttccacgtcgtttatcccgttcactaaaaatagcgttccaatcagcactggtgaattcgcttccattagtggtatattggaatagaactttcattaggggaacgacacatgcatactatcgaacaactcaatgacgggcgcgcggtctatctaaatggtcaccgcgtcaatgtcgccgatgtgcccatttttcgtaaaactttagcactcaataatcagtactatgaccgcaacacaaccatccctaagtacatacttatcaggaaaatggtcaccgctacgatattgctttcaaagtgccacgcaccgtcgctgatttacaacaaaagcaccgtgcttatcaagaaattgcgcaaagtaacagcggcatgttaggccgcacaccggattttcttaatactgggatggccgtcttagcagaacgcgctgctgccttcctcgggcaaaatcaatatactgattttgcagctaatgcccacaattacgctaaggaggtcaaagctaacgatatcttcattagccatgcgcttcaaaacccacaactcaaccgtcaaaaagccatcaatgccattccgtctggatacgcgggtgttcataccattgaacgtaatcaagatggaatcttcgtttctggtgccaaaatggtcaatacgatggccccaattgctgatgacctcctgatttttaatccgccggaactgttgttagaaaacggcgatagtagttatgctgtcgcctttgctacgccactcaataatccgggcgtcaagatcatttgtcgcaaattattagatcatcccaccgcttccattacggattacccactcagcaacgcccttgatgagattgacgcctacattgtctttgatcacgcctttattccgtggtcaaaagtatttgttgaaaataatgttgaaatgagtaatcgtttcttcatcgattcaggcatgtttagccacacttcccatcaagatgaggttcgaggtattactaagcttgagttagcaaccagtttagcgcttcggattgctcatatcttaggattagatggtttcttaggtgtccaagaaaaactcggtcggttaaccgctaatctggaactcatcaagggtaccatcacccgttcagaagacaacggtcatctggacgaattcggtatctatacgcccagtctccaagctttgcaagcggttcgctcgacccttcccgaatactatgacgaggccttgcgcgtgactcaacacttagcggccggttccatggttggcgtgccaagttttgcggaatttgacggcgataatgcgacaatcctcaaccaggcactcacgacggaccgagccaccgctaaaacccgcacgcgcttgttgaacttagccttcgatttaacaagttctggctttggtcagcgccaattgatgtacgaatactatccatggtggtgatccaatgcgtattcgtgcccaacattatcaacgcgccgatttacaggctggcaatcagatgattgaccgactattgtcagcggacaacgcaaacacccatgaataagtaatcacaccaatacccaggttagtccttaagtgagtattggtgtgattttttgcgcctttatattattgactatttagtcaaatataattcgcgtaactgttgacattccgctgaggtcagccctagacccgtctgcaagtaatttgaaaatgtgtcgtaccgggctttgatgacttcaaagtaatggctcaggtaatcagcgtctactaataatgcctggttcacggcccgttgttgctcatcagataattgcgacgccatcgtcgccaagatttgttgattagcagccgcacgtgcttgatttgtgagcagatagtcagccatgatttgctcgtcactaatacccaaaatttttagaaataaggcggccccgacgccgtgcgtgcgatccttaccggcaaaacaatggaacagtagtggctgatctggaaccagtagtagctgtataaattgacaataactttgacgggcagtaggatctaacactagctgttcatataactgaaccatgcggtcatggaccgcccccgtactactaatcatcgattgtaaacttgcgtcgttcgtcatgacttgtgctagcacatccagcacgtgatactggacgtgtggccatgtcgcatctggaaattgatgacgctcatcagcactacgcatgtccacgattcgcgtaatgccaagcgtggttgctagatactgcgtctgtgccggtgttaattgatccaattgtcctgaccggtaaattaaaccatctttgattacttgctgatttttattgcgataaccacctagtgaccgtaaattagtaatcccttccatgaccaagcccccagctagattgataacttaattgtaaactgtcaccgttaaattttcagtccaaaaggccatttaaaaagtcatttagtcaccagacctaactgatctggtgactaaatgactttttttaaccgctaacttgatagactcaattaatcaaagtgtcgccattcgtgatccaacaacgcacgcgctacaaatagcccgagcggtaaaaacatgatgattaacacggccttcgtcagccatagtgaaccgacaccaatttgattattgccaatactataaattgcacgataaatatataatcccggaaccataattacgattgaaggtaccgtcaatgaaatccggggatagccgttataacgattaaccaccgatgcgatcaagccggcaacgagcgccccacaaaaggcggccgcggccggtggcattgctgtcaagtcaactagttcaaggcgcaatgtattcgcaatggccccaataaatcccgcggtaatggccattttttgcgagctattaaacattattgagaacccgtaaacaccgcaaaaactagctagggtaatcgtaataaaagtaccgctaacggtgaaagtcctagcggtaagaaatcagctggcttgaagctcaccagtgtcgcgactagccagccgacgagagttgcaatcagggtaaccataatcgcgtaagctaagcgctccagtcctgagcgcatatccaacttagagatatccaacatactcgtaatgaacggaaaacccggaatcacgaataacatggcaccaatataccccgcctcatgctgggcaagaatttggaaattatattcaaaaatcttaaaactaaccatataagccaaacacgctaccgcaacgctgaccgcaatcccggcaaccgtcgtcatcgaccgtttacccatcagcgcccgaacatagttaccaagacccgcgccccaaaaggaacaaatcatctcgggaatacccccaccaagtaagaagataaatccactacaggctaagccagctgccaacccaagaaccagtggagaatactgtttaggacgcgtctgaacttcatcaattgctgcatgcacttgtgccaccgttaaccgtgcatatttcgcatcaaagtctttgacaaactgttcaagaatatttagtttatccgtatttacaccagtatttggtatcgataatacttgcgtataactacgttcatgatgaaaacacgtgtactgaatcgaaatcaacccgatatctgccgagcacgttaaattcaggctgcgagcaatcttattcatcgcatcacgaacccgccacgctcccgtcccacacgacaacattaaaatgccaactcgaccaacaattgatgttcgctcttgtaagctagcatgcttagcgggaacatcttcattacggataaagtccttccatggaattgtcatatgatgtcgttgtgatagcggcatcaccgacttacgctctttattcatttcttcctccgtcttagatcgttcattatgttagtagctttcccccttattttaggctactaacatcatttatgatagcgattttgtcattttaaaagcataatgtttcacgtgaaacattagcctcatgatgagtttccccagcttgttaattgaactaccccctcaaaagtaaacttgattaccattcgttaatttaagcgtcacaattttcgccgctatccgcaatcatatgataagttaccgatatcatctaataaaggagcgatttgtatgtgcactagtctaacttatacaaatagtcatggaggccacttcttagctcgtacaatggattttaacgttgactttgagacccgtattatgttcatgcctcgacattaccgcgtgacgggtgaccttggtgatttcaccacgacttatggctttattggcgcgggtcgccaactgaaccatgaaattttcacggacggcgttaacgaatgtggtgtcagcatcgcagcactctactttccgaatcatgcaatttaccagcctcacagtaaccaagacaaaatcgatgctctcgcaccccacgatttcgtcgcctgggtactcggaaaaatcactagtgttgctgacctacgtgagcgcgtcaaagacgttcaattgattagtagcacggcagaattaattaacgaaattccaccacttcactttatcattagtgaccaaaccggtgaaaccgccgtcttggaaccaactagtggcgagcttcgcctgattaataacccagtcggcgtcctgaccaattcaccgaacctcaaatggcagctacaaaacttaagtaagtatggcaccctgactaacaccgagcggccactaaataaattcattaactaccaacctggttcacagggacctggtacgggcgcattaggtctacctggtgactatacttcgatgtctcgctttgcacggaccgtcttcttgaaacactatgcgctagtgccagcgacaacaacagatacagtcaacttacttcaacacatcttgaatgctgtgactattcccaagggcgccaaagtagccgccaacggccaagcaacctatactgagtaccgtagctacatggacttgaatcatcaaacgtacgcactagatctgtacgaaaatccgggagtgattcagcaagttaacttaacggatcatttattagaaaaacagaccgttccgttagaatacgtccttagtcgcaccccacacgtccagttactaactcccgatgttgccaccttgccagcggcccattaagactttcagaaaagcagtaactcaaaaaagcttgcatcacaaatctagttgactttgtgaagtaagcttttcgtattatttaaacttaggctaacgcggcttttagattagctaaggttaattcgctcgttgaagtgaagttaacatccgcacccgtcaaaatggcgggatcaccaatcccaatcgacgtttcaccagcaccattaattgactgaataccgaccttagcatcttcaacgcccgcacattcttcaggcttcaagccaaagacacttccgcgccacgtgcgaagatctctggatctggcttaccgtgtttcaaggtttgggatccacccgggcttcaaagtaatgcgccaagcctaactgttccagaaccaatggtgaattcttagaagctgaggccaaggataaacgatacccatgcttggcgagatcggctaagaagtcttcgataccaggtaaaattgcagttttatccattcccttcaacaggttcagataattagtatttttcttggctgcgtaagccactttttcagcttccgtatagtcgttttccttaccacccgtttttaagattaagttcaacgagtccattcgactaacaccctttaaattatcggcaagttcttcactccaggcaacgcccaactcgtcagctaattgatgccaagcttgtgagtgataaacggacgtatccgcaatcacgccatctaaatcaaatacaaaccctttaatatctgcaaatttactcattaatggttcctcctctcgttaattaccagcacaattgattgctgggtaccggacaactgcgcaatcatcaatagatgcgccaagagtgacggctacccgtcttgttttgaagcacaccgttaatgttcacttaacattataaaacgctttcagtttcaatgcaaccggttgcataacaattttaatgacgactgttgctaatcacatgcccgcccgccgatcaaatcgcaatggcggccccattattgccgtccatcctgaatttacggatttactaataatgactgatccaaccatttttccacaaacggttgcacgcttttatgcccacttaatcttgggtcggaattggaatatccggtcgatactggtactgatgctgggttaaaaattgccgtaatttaaaactagcagccaatttaaagcacgtttccgcatcccgtaaatcgcatccggtcagtgttgtgatatggtgcagtcgattacgcagtgtatttggatgaacgtataatttggcttagccgtgcgggtcaaattacaagtcgcccgtaagtagacatctaatgttggtaccagttctgtatggttttgctgatcataggctaacaacaaacgtagggctggattaataaagaacggtaagatctcaagatgattaactcgtgccaacgcaagattatagaattggtcttcacaaaaatcacccgaccacggccagtcttcagttgcgccgttcgttcacaaactgtatacgcggcaaaggtatcttccggattaacgtagtgctgagacacgatcaagcggcaatccgcttgcttcgtaatttgctgcaacgttagtttaaattgattctgattatatgcgaccagactaattgggatcagtgccacacattgttgctgataagtcgaaaccaacacttgtttgaatcgtggcatcatcaagtactgtagtcgctgctgtaaaatcatcggtgcttgatcagctagtggttcgcagcggattaacaccatggctgtcggtaattgcacgtgttgttcagcaaactgatcagcaaacgttcccccttgatgttccgtcaataataagtttaataaccggtcccgttgcgattcagctgttggcataatctgatttttaactaacgagccagcgataacctgaccaatcgaattgatcagtagtgcttgtcgatcattcagtggtttattgagtgctggcatcaccaaataaccgatcggctcggtgccatttgctaacggcgtaattagcatgggccccgccgacaactgatcttccgccacatagacttgcgttaaaaaatccggcgtatccggtgcaaatccgtggtctaacagccagcgtccgactcgattcgtctcaactgcagcgtgaatactagtcccattgagttgcgtcgtatgcgaccgtgtcagaatctccccgttcagatcaataatcgccagcggattctctaataagtgtactgcttgggccagtgtggtatcaaaagactccgccgtgattgcttggatagcgagctgattgatggctgcttgaatttgaacatcgtggtgtaagcactgaccaagcgtcattaataatttcaataactgattttgtgccgcaatgatcgtagtcagaccggttcccagatttactagtccgaccgactgacgatggccgtgccaactataagcaagttgaactagctgacccgagtcgggggacaaatataaccggtggcttgctaacacttccgtcggatcaacaaattggacgtgagtaacttcgggattatgtgtaaatgttggatcgacagtcacctcaaacgttgtggctaactgccgcaataacggctttaattgcatactcaagtaacctccttattcacgcttgtcgccttcatcataaataatgtaagcgcttttgtaaagaggcctactgacaacccaccaccccactcgaaaggccctcagctttcttaggcccgtattcggacaaaaagagcgggaatcccgctcttttcataaacctattaggctaagaaatcagtctgtgttttggcatcgtaccgagtcgtatggagcggttcttgcgctgctttcccgattgcgatccccattactggcacgtatcgtttaggatcaagacccagcgtcggaatcatcttttcaaagtcaattccggagaacgcattggcatcatacccatgagcccgtgccactagcagcaactgcatcccgacaacggaacaatcaatcgtcgcatcgaatttcaagaaatctggtgtggcattttcatataatggtaagaaggttcccagaatctgatccaagcgttccttcgtaatattcccatcctcataaactttgttccagacatcgcgataaacataatgcgactgggtgtcaccggcaataaagacgatggccgatgcactgtcgacctgtgggtagttgaatttcatcacggcttgtttgaacttagcctttgcctcgggggtatccacgacgacgacaaagtgccatgactgtaaattacatgccgatggcgcggtggctgcttccgcaatcatcttttgtaactcatcacgtccaattttaacgttcgggtcaaactgccgaactgaatggcggttaaacatcacgtctgctaaatcattgttcaccaaatttttactgcttctgacatcagctattcctcgctttcgtaatcggcctaaataatgtaagtcgctgccttgggattgaagaaactccggtcataccgacccgttaagagctttggcattgttgtcgcagcatcaacttcgtccaacttcagtgtgttgaacataactgacgtgtcgaagtggaaccaagcggcaccgagtggcttcaagaccttcaattcgccaaatggatcatcatcggttgactccaactgaatacttaggttcccaggttcaacttgatcagctaaggaccgtaattgagtcgcaactaattggacattactgaaatggttcgttcccatcttcatgttgatcaatgtcatatttatagaagaaactattcatttcggcttccttacctaacgcgagctgccccgcaaattgtttcataattgacggatcattcagttcaccggccgtccacgaaacgttcagtaatgtcttgccatggcgttcgaccgtggctgtcgcactgttgtcattccggcgcaattcgatgtcatccgctaatttcttaggaatcccagcaccttcccgacgcaatcacaccactctccgccccgggaccgtggagtaagaggttaatcgggtaagcgcccatcattttatccttgtagctaactaacgcaaataggctttcttcaaggtatggggcactaaaagtcggttttcccatatgaacgacataaccgcaaaccaccggtgccattaattttaatggtgctggaattaaagccttaagcaccgcttcgtcagtggcataagcaaacccaataccttcctggtcattcatgctttggtgctgctgtcaaaaagttcttaacatcctgatcacttgcaataaaacttgccatggtaaaacactcctttgtttgcgtgattagcttacatgataccgtccatgatgtgcacgtctggtgcgccatccgtcacgatccgtttaactcggtcttcaatcagtggattatattctggatgggtcaaaatgtagaaacggttatcctctaaggctttaaagacggtatcggcaatcgtatcaattggtttcccgttggtaatgacatacttcgcaaattgttgtccctttaagtacgcttcactttgataatacgggtccgttgggtcgctgtattgcgctggccggtgattttcagtgtgatagagatccgtctgaacaaagccagggcacatcacgtgcatgtcgatatcaatattagcccgttgtaagtcataggcggtcgcttcagtcatcccaacagaagcgaacttgctagcatgataagaaggcattccgggcgtatccaactaagccggcaatcgaagccacgttaagaatatccgcatgggtcttctgttgaatcataattgggataacgcgcttcatcgcataaacttgactcattaagttgatatgcatgatccattcccaatcacgagtcggcaattcccaaattcggccaggtagcgcgatcccggcattattaatcagtaggtcgatccgcccaaacttttccatggcacgctcaaccgcatcgtcgacactagcttcctttgtaacgtcagcggtaaccatcaacacctcggcacccttgtcgagaatatgttggtacgttttcttcaaagctggttcgtcgatatcaacaatcgtgagcttcataccccgatccgcggcgccttcagcaataacttgaccaaatccgtgggccgcacccgtgataaacataactttatctttaaaatctttcatgatgttttgcgtcctcctcgatgaaattgtgattttattaacttatcagtaaacattttaacctgatgaccggtcatttatcttgactacgctttcatattaacccactaaatttgtttgagtaatggataaaagtactagtcttacgacgattaaactgtagcttttatacatgtgtgttggttcacaattataactaactaaagtgtggttccaactttaattagctaataaaaacgcatgccagcccttcttagcttacatgcgcatcattataattggatttattttcttaatactgcaaccgttcattgtgcacggctacgttgccgaaacattcaaggtccgtgccagatcaatcactcgtgctttgatctgatctcgacctgtcgaaatactagcaattggtcactaacactgccagtcgtgcgagccggatcaggcaatggccagtgtagcctggtcaccgttgccggagtgacggggcagcgatcccgtgcatcaccacacaacgtcaccacgactgcacactgattaagataggtcaggtcgattaagtttagaaacctggtcactgatatcaatacccacctcgctcattacttgaacagctagtgggttcaggccatgtgtctccaccccagcactagcaacttgccagtttggtcccaataattgctgtgcaaagccttctgccatctgactgcgacaggcattgcccgtacataaaaatatatttttggcatttcgccgtcctcctaaattactgacgacaacgacactaatcgcgtatcatcaccaatattatgcccgcaagaatcccgcttgctccgctaataaccattaagatacaacatcgtcatgcgcgtaaccgcgatagattgctgtgactattccagcaatcgaataagctagccttaaccctcaagaatgcgctcactatatttttgtaatcgatttcaaaacgatttatactagaattgatattacaatattattctaaacttataaccagtcccctgagcagttactcatcgcgagaacggtcttatttcaactaataatttatcggaggtcttttccatgacagtagcaattcgttatcaaactcgcaatggcaatacacaagcatttgccgaacaaatcgctagcgtggcggtgttccagcacaatccatcgatacacctgtcgaacaagctgacacactctttttggcggcggtacttattttatgaaacccgacaaaaccgcatctgcttttatgaagaaccttgatccgactaagatcaaacaaatcgccctattcacaacttctggcggaccagaaatggtttcagacaaagccctgacaaagattgccaccgaaaagggcattcccgtcatcggccacttccaccaagtcatgggtggcaaaggaatgaaaatcatcggcagtactggcggcaagctcaaagatgagcagattgaactcgttaaggaattcgctcaaaaatgttagctcaataatgatttgacggcgctcgcgttgactgaaaaagtcaatgcgagcgctatttttggattagtgctgaagacctaattagcccgtctaatttgacgtaggacgtcaatgcaccgctgctgattagcgttaggcaaaaggacttccgcaccgccagttgcatgtaacagtgtaattgctcttgggcagctagtggaatccctacaacctgatcacttagcactacggaatctgcaatgaccaccccaacaccaacgttttgagcaactagaccttcgactaacgcgttggtagctgcctcgtagacgattttaggctgtatgtggccgcgctgacaatattgttctaatgctaaccgtggtaatgcgtgtttaggacgagcgatgataggcactccttgtaagtcagttgctcgaatcgtttttaagtgacttaatggactattgacattggccaagacccgcatctgatgttcctctaagatgctcacccgtaaatccgtggcacgttctgggaccaaagttgaaaaaaccgctgcgtctaacttgccttgccgcccaagtcaactaacaattgttctgaatcagcaacggtcgttgtgacctggtctaataaatcaactgagataaatttttttatcacccggggaagccaaataccacccgcaacattggaaaatccgagccgaacttgctgctcattagcgtgatgaacttccagtgccatctgcgcaacgtcttttaagagttgcttagacttaatatacaaggtccgccccgctgccgtcgttactagttgggcccgatggttggcctgcgttagtaatactgcttggtattcttcttccaatcgtcgtaaagctgcagaaatagccggttgtgtgacgtgaaacttggtcgccgtggccgtgtaatttcccgtctcaactaatgaacagaagtactttaaatcgcgttcattcacgtcaacgcccccattcaatctatttaatacctaattttaacacgaaagatgcggcaaatcgtggtcaggatcaatcacgacttaccgcatctatatttgctcagttagtcttaccaaaagcctaataacttggtccacagcaagcccccacctaaccagatgacgttaaaaataaccccaataattgcactcaatcgccaccactccgcactagtcacatagcctgtacttgacaataatgccgcgggcccggccgagtacggcgtcgttgacaagttgattgaaccagcaaatgccaatagtaacgccgctaaaacatggggaacaccggcaccaatggcgatggataaaaagccagcatataacgccgaaatctgtgttgaaacactcggaaacatgtaatgtaagtaaaaataagctaaaaacaggataatgagcacgctaatccagttcataccattcagtaaatgacctaacgttttggaaaaccatgggaaaaagcctagtgtcattagcttcttagacatcatcatgatgatcgataaccagactaaaatattccaagcaaaatgttcattgagcaaatcgttgagtcgttaacacgcccgtaatcagcaaaataacaactgcaataaaacttacttcggtcgcatcgatgccaattttagtcccgatcaaccataaaacaatcgctaaaataaaggtaattgacataatttttttcactagctgtcatttttccaagtgcggccaaacgcgtcgttgcccagcggtgcgcgtctggcgtttgtttcacctcagggggatagactttatatagtacccatggaataattagtagcgataaaatacctgggacacaagcagccataaaccattgcatccaagttaccgtgattccctgcatcttagctaaaccaatagccaccatgttgccagctaaaccggtcaaaaacaagcctgatgtaatattattaacttcatattcattaaaaactagaaatgagcctaattttcgctgtgtgccctgtttcggatcagatcccatttcacgagaaagattatcaataatgggatacataatcccgttgacccgcgcattattgctaggaataccaatcgccaatacggcatcaacaaaggataaggcgtatgctaagctcagcgtgcgcttgccaaataaactgacaaacagataggcgatccgcttgccaagtcctgatttaataaaaccagcagccatgaacatgcacatggcaaccatccacgccgtcgaattaccaaaaccagtagcgacttcgtccatcgtaaaaacacccgttaacgtcgcgacaacaatcccaatcagcgtgacggccatcatcggtaatggcttggtaatacaagcaataatcgttgccacaaaaattgcaaataagtgccacgccataatactaattgctactggtcgtagtggcgtaactagccataacccaattccaaaaattagcggtaacagaaagcccttccattttatttcactcaacatctgcacttcctcctaatcttcatataattgttaagattttcacatatcttgccattaaccccggttgtttgccgtttttcaatatcaccataacttaatttataagtctgtcaatttaaatttagttgtagttgcttgaggtgtcgcaataaaacccgttatatacagcctacagggacctgtttgcgattaaaaatacctgaaattatcatagcgactagtgccttttatcggacacttttataaatagaatttataaaaagctaaaataaagtttgccacttgcttaattctcactaaagtttcgacaacccgtcaaattaatcacagcttgttatccttgtcacaatagcattctgttggcttcgttaaaattaacggttgttttttctaggtaactatttatattgaaagcgtaaacaatccgtgtacttatccaactaaaaaactaataaaggaatgttaattatgaaatatattgccttgattggtacggcggcacaacagtcttacaaccgtgaattattacaatttatgaagcatcattttagtcaacgcggctaccattgacgttaatgaaattacagggattcccctttttaatgaaccaactcaaaatcatatcccggcgaccgttcaagccttaaatgataaaattagccaggccgatggggtgatcatcggggtacccgaatacgatcatgccattccggccgcactcaagaacgttattgaatggctttcttaccagctccacccctttgctaataaaccggtcatgttagttggtacttcccttggcgtacaggggacgtgccgtgctcaaggtgacttacgcaatattctcaatgcgcccggagttgatgctcaggtactccctggcaatgaatacatgttaagctacgctgctaaagcctttgatcagaatggtcaaatgaccgatgccccttctatcaagttcttggaacggtgcttcgataactttgaaaaatacgttaaggcactcaacggcacgcccgcgctcaatgtgaactggcacggtaactacgacgttatcgttttaggctttggtggtgccggtgcttcagcggctcgttttgctgctgataatggtgcccacgtactagtagttgatgcggcaccatttggccgtgaaggtggcaacacccgctactccgcccaacacgtcgttacgggtgaaagcttagataaactaaccgcttattatcaagcactgggcgcgccattcagtacccctactaagacactcaacgcctatttaagcggtatgagtaaaattccagcatattttgaaaaatatctggggattaaagccgttagttggaaacatgatattaaacccggtgatgccgttgccatcaagaaaaccatggcggaatacccagaactagccggaagtgatacgattgactttaccctcgttcacaaacgtgataaagacgctgcattatggaaactactccggcaaaaagtccttgaacgagctgacaatattgacgtttggttggactcacgggcacaacatttgatccaagatccctaatactaaagtgatccaaggggtccaaatcaaacggggcgaacgactgcttaatatccatgccaataatggcgtcgttttagctatgggtggttttgaaaacaatcctgagttaaagcaaacctacttgcacagtgataatctgacaccacttgggacgctctataaccgcggtgatggtatcaaaatggctcaagaagttgatgccaaaatgtggcacatgaccaattatgaatctcacggtatcttacctggaatcaccttcaaagaagacgccaatgaacggggccgtcaaattgaacactggcctttattaaagaacggtagtattttcgttatcgctgatgatgggacacgctacttccaagaagacgctaagcaccgtcacggacacgtttacacacatggctcttggctaatcccaatgaataatcagcacccctacttaatttttgatcaaacccagtacgatgccttcaaacaagaagaaagtcagggctggtcagttaccgtatccgaaattcatgaccaaactcgtttccgcgccaacgattgcacaattggccgccaaattgggagttccgctaataatctacaacagacggtaactgactttaatcactacacagaagtgggacgtgattttgaatttgatcgtgatccgcaaacgatgcgtcaactggacgatggcccttactatgccattgctacgaccaatgacgtcctcaacacgcaagggggccacaacgcaatgaaaatgcccaaattctcaacgtcaatgacgaacctattccacacttgttcggcgctggtgaattaggcggtatcgttgcaaactgctatcaaggtggtggtaatttagccgaatgtttgatctttggtaagttagccggtgaaaacgctgctcgtccaaaggtagatagtgaatctgtcaccgccaacgaagccaacggaattaatgaccttgttgatggcgaaacagcatctaatgttaaactcgggccgctgatcaatatctcggcagttctaatgccgggctaggtggcaaagttattgtgcgtgtgacttacaacgaccataaaattcaagcagtcgatgttattcaacaccatgaaagtgaagatgttggtttaaccgctatcgatcaaattccacaagaaattgtggcagccaactccactagcgttgacgccgtttcaggtgcctctgcatctagccgagctattaaagaagcggtccaaaatgcgctgaaacaagtcaaagattcagtcacgaattaagcacaattcaaagcgaatatgtatttgagaacatcacgtaactcacgagttgcgtgatgttttagtgtcccgtggcgaaagtttcacgtgaaacattttaggacttacggtatttgatttccaaatataagttatgcaaggtgcctatcaaaacagacaccatctattgccaaaatcaacaacatccgttatactgtttatcgctgtggctataatcggcacacaaataaggagatgattaatgatgatggcatcattatctgtacgcaaaagtgctgctcgttagcgacacttttcgacagaacctttcagagaagtgtctggtttgaatctgaaaggaattatattatgcaaccgacaattaccacctatcaatacagttatattactcagcaagtcaatcagttaattagcgccgagctcgccgtaaacgatcttcaaattagagccgtcgtacgggcacaagctatcgagcggattacaccactgcttcctagtgacgatccaatcaccgctaatttcttgtcccatttgcaaacggaccggctaacccgtgccaaggcccctcaactactagaaacgctaattccgctaattattccgtttccatccttgacgacaaagcaactaagcaagttgtttcgcaaggtcaaaaagttgaagcagcctgtatggtcacaattagcattacacgaattgacttacctaggttggaatgatgattgtggtaaccagaaaaagtatttagtaatcccggatcatgatcgtctcattggtatccagggagatctagcaccacaaacagtcaagggcgtctgtgccatttgccaaacaattggcaacgtcgcactctttatgtcgacaaccaagtcatctggtctcggaccttacacgcgtaacggcaattacatttgtcgtgacagtaatcagtgtaatcgacaattgaccgacccgcgaggctttagctgactttttagcagttgtccgtccaaaacgataattaaataaaaatcagggccaccaagaacagctgcaactgtcgttcttggtggccccttcattaatcttattcggtgacactaatacaataagcgcgtgttggcgaatcactaacttcaattcgcaacagttgcgccccgttgtctcgcaatgtcttatcaatcttggtaaacaaatactccgtgacattttccacagttggattaacggttttaaattcaggtaaagtcgttcaaaaatttacctgacaattcatccaacgcttgatgcaaatttttttcaatatcataaaagcaaccatcgcatcaaccgtgtgcaattcacaaacaatttcccacgtgtgcgtgtgctttttcggagccagttgcccaccgcaccgcatggctagcgttgacataggacttaattttgtacgttcgttgtttagtcgtcattgcccagcctcccctatcaggttcaagttaccctccatcttagatgaaacggtgtcagttggcaatagtgtctgctggtaaacagctggtttctgctgcaaaagtgagtctaaattagttgatgatgtgcaagacttgcggcgtagcaactcggtcagttcgaaattgatttaacggtttttcaggtttctcatagcctaaagcaatccccatcgccactactttatctgcgggcatcccgagtgcgtttcgtacaatggccggatatttaaccagttcataagatggtactgactgtactccgcgagcagttgcggctaacattaacgtctgcgaaaaagcgcctaaatcatagattgaccaactattagggttagcgtcgagcacgagataggcaatcgccggtgcgcgataaagattagcacgactatcccaataagtggtcgggtctgagtcgatcacgggccgaaaagttccgacccagtgccccatattttggctagcaaacgccgaaaaatcaccccggtgtactttggcgagatcagcgtcttccgtaatcccttgctcagcggcagtagcatagtgttgcttaatattagttagtgcgtgccccgttgcaatatagacttgccatggttgtgaattaccccacgagggggtttgctgagcatctgtaacaatcgttgttaataactgtggctcaatagggtcgtctttaaaagcccggactgaatgccgggtgtgaatcgctttaattgtttccatgaatttttagctcctatatttttaaatagtgatgaacaaagagaataaatatcattataaaagatagaactatctttttcaagcaaggaaacttggctagctaagcgcatcgtcataaaccagtaaactaaaaacgtggtaataccgagccattcatgctcagtattaccacgtttttaaccaaatcaggcccttgaagttacagtcaacaagctatgaacactggccttaacaaggctgtcgtagaccttattttaatgcaatctgtacccgtcgttgaagatctggcaccacggtcgcttggaaccatggattcttcttttgccagccataatttaggggcgatggatgcactaatgggaaataatcaggcaagtaatcctgataattttgaaccgttgcagtcaacgtcttttgccgtgaacgtcctaaataagccttaattgcatattggcccacaagtaacgtcagttgaacgttaggcatcattgctagcagcggttcatgccatttatccatggaagcccttgcgcggtggcaagtcaccgcttttgcctttaccaggatagtagaaatctagtggcataactgcaatgcggtcactttgatagaattgctcccgcgtcacgcccatccaatcccgaagtcggtccccgctcgcatcattgaaatacgtcttggtattttgggcaatacgtcccggtgcctgactaatcactaaaatagtggctgtcggtaacacatgaaataatgggtcccaccccttcgccgtatattcagcgttatcgggatcagccttgatagcttcagtaatttctttgattgttgtgatatagatgcaccgcgattcgtttttagttttagtgacgatacttttcccatgcctgtttgattaaactcagaatatattcaatctgagtatcatcttttataattacttcataatttccaatgaccagtgctactttgtcttattcaatttataaaaatccatattaatgttcatacttatactagtatattttacatcaattagtcatagacacgaagaaaagtcctaaccatgttattgccctagattaaacacgacttcatagtcccaacattcgcttcagcagcttttcattacgtttattatggatcggcaccattaagcgcgtagtatattttgccaaaacaccttgcttatacacagatttttgattactaaacgtctcaaagcctgtcttaccgcctttatagcgtcccattccagaataacccacaccaccgaaacccattgaatgcgaacccgcatgcaaggataactcattaatatctactccgccagatgatgtctgcgaaataatttgattcaaatgccttgaactcctaccaaataagtacatggctaacggcttttcatgagagttaataaaagcgatggcttcatcaagtgaatcatacgtaaagatcgataaaataggtccaaaaatttcatttctggcaatctgtaaatctcgatcaggattaatcgccaatcgttaatggaattagccgtcttttcacgtccggaaccaattcattatttggattaatcgttatcagcctagttccccgttgccgagcttcagtaagcattctcaaaatccgatcgtaagaacgatcgttgataatggcagaatagaattattaatgtaagttggaaatgcttgcgcaagttgtgcagtgattaagcgcacgtattcatccaactggtcagtgggaagtaacacataatcggtatccaaacaaatctgaccactattaccagaacgactacgcgcaatcttggcagctgtcatttgcttgttagcatctggtaaaacaacggctggatttttaccacccagttctaaaacaaccggtgttaaattaggagccgccgccgataataccttcttaccagtttcagagccacctgtaaaaactagtttgtcccaatccagtgctgaaaactgagccgcaatatcagcttctcctgtcactactgcaaaaggttcttttcatttaaatactgttgtgacaatttctggaccagtgccgctgtcttaggggtatactcagagatctttaccatcactcgattccccgctgcaatcgcttctaccgctggatctagcgcaagatcgattggtgcattaaacggcgacatgataccaactacacctaatggttcattataaacatactgtttagttccagttaatgccatcaaacccgaccgttgcttagctggtagtatccatttacgaagatgcttcttaatatatgcaatcgtcgctagtggtccggttaaatcagcacttacaatttgtagcggatcacgctgcccaaaatctgcttgaagtgccgtgattaattctgaaatattatcccgaatcaatgcctcaatctgatttaaaacagtcacacgctcttcataggtcattggttgcgcacggtcatactgtgtcttttgcaagttaaaaatttggtgcatctcattaattgtagtcatcatcatagctctcctttttaatcgaacaatcgtttaattatagacaaaaaaatatcatgttctgatattttattttttcaatagtgcattcatacacatcacaaccacttgatcgatcataattgtcttattatcaatttgacgtgtttttaaggctttaacaaacaaaacaattggtgcgtaaacaaaacctaaaataactgccggtgaagaaatgacaaattcaggtgtatgtttgactgcttcaaaaagttgctcgaaaccttgataggattcctcctttttgatttttaagctatcaagaatgggcgaattattgaattgttcaataatcattaatgcttcgtaatattgcatgccgaaatcgtataacgcatacataaactgttggacaaacttaactgagttattgggtttggtattgatattttgacttaaaaatgctgctaactgtcgctttttagcaaggtagacccgctttagaagatcctctttatctgataaaaataaacgtaaatagttgacgaagaaataccactcgctttggcaattttggacatcgaaacatccgcaattccctcttttagaataatacgacttacttcatcgataatactcttctctttgtctaaatctttttcccgcatatttggcaccctcttttaatcgattgaacgttcgattaataatataaaactatccctaataaatgtcaattaaaattattagaaattttatggatgtggcacctgtacgcaaaaaatcactagctatatatacctgagaatctacaatcagcatcttgaggattgggtatactcaaaaacggcaagcctttttgaggagcaccgccgcttactttgctattatcaatcaattgagtatagtgataaccaggctatttcaatctagccttaatatcagcatctgaaaaatcgttccgtcctttcttatttcgccattatttaatggtaattgcatatctatatactgcttacactttagtaaggtaactgtaattctttgcagccttatctaaactgttataaatacgaccatcaaaaacagattagaattcctattcacctaataaatccgtaactattgaaaaacaaattttagcatcacttatgatacggacttcccacattaatcataaacgcccgataaaccctgctccgacagcactaaccgcattaattggtgaggtaacgtgaaacgcccaaacgaaatctgagtatccgcgcgcttcagcacttccggtgataaccccagcgaaccaccgattacgaaatcaatatcactgtgaccatacgtcgttagtttatcaatttccgccgcaaattcttcactcgagcgttctttgcccaaaattgctagcgcgtatacgtaatcgcgatccttgatcttttctaggatccgttggccctctttgaccttcacattttccatctctgcgttacttaatgactctggagccttttcatctggcacttcaacaactctggaattttgcaaatttactcattcttttcgcatattccgcaatcccctgtttgaagtatttctcttttaatttcccgacacagataattttgatgttcataattgaccgcctttacacaagttattaacatagttatccacaggtgcataactcaataatcaatatattgtgttgaacgccagttcgccacaatatttatttagcctcgttttgtcaagacctttccgacttatccacagttttgcacagcaacacttgttcgtgggttccggttacaaatcctattatatcaagaaccgagacctattaaaataactttttaaaattaaatccacaggccagtccggcgcctgtggataacttttaaacaagcttcaaccccgtggttccggctgttcataaatttcgactaacgcggctaaaatttatcaccaaagttgtccacacttttgcacaccatcaaattcgacaataaatgctttctgctatttcaaaccagtttgttcggcttttgtcgcaaccattgccagctttcgcaaatttagtcgattattgaaaatcgattcttcgttttttcatgatttcagctactaacctaaaaaaacgcccccgactgctttatccagtcagggacgtttatgaaattctcatttattagttactttgtttagttaacgttttggtagtttccgtcaacttcatgttggctgtcttgagttttccgttatggtagtatttcaccgtcacggtatcattaaccgaatgggcatacagggcactccgtaacgtggctaagctggtcactttcttgccacctagctccgtaatcacatcgtacttcgttaacccagcagctttagccggtgaacctgagtacgtcttcatgatgacgacacccttcgtcacactggttggtaacttaagaacagacttctgatcactagaagaaatattggataggtcataggttgcaacccctaaagccggccgaactcggacttcacccttttgaaccaattcattgatgatcttcacaacttcattacttggaattgcaaagcccatcccttcgacactagtcccagaattatctgaggccaacttcatcgagttgatcccgataacttgtccagcaatgttgaacaacggaccaccagagtttccagagttaattgccgtatctgtttggataaccgtcgcgtaccccgtcgtttgaccagatgtattcgtcgtcgccacggtccgcttcttcgctgaaatgattccttgcgtcaaggtcgttgcgtaattagagcccatcggtgacccaatggctaaggccgtttcaccaaccttgatattatctgagttaccaaagctagccgtcttcgttactttagaagaattgattttcagaacggccaagtcagtcacagaatcggttccgacaattttagctgacaacttagtcccatcactcataatcactcgaatggcacttgaaccactcaccacgtgattattcgttacaatataagccgcgtcaccgctcttcttatagatcaacccagaaccttcactgtactcttccagcttactagagctagaatctgaactggatgaactatcactgccagacgagtcatcgccacccaaaataccactccaactgcttgaagagctcttcttttggagattaatgaccgatacaacggccgccttgttattttcaaacaccttggtcgcctgtgaactgacattgaccttaacgttcgtcgttgacgttgaccccgatttattagaaccagttggtacactggtcgatgacgttgcgatgttattgttttggaaataattaataccgccgtaagcaacaccaccaccgattaaaccagctactagtgcggttactgcgactttgattaatgatttattagccataattgcgcgtcgaaacgcgatccctccctactaatgcttattttaagtttattttagcgaaaaagtgtgattttttttatgactgaagcgttgtgaaacattaaagctaacctataacgtgattaacttagtcgcttgttctggctccgtatcgtacaattgaaaatcatgctcaacgccaaaatctcgttccgtcatcatggaagcaaccgttaaatgcgccaaggacttcaagttattatcctgactacgatgccctaagtaaatccgcttggtatgccggccaatcacatccatcaaggcgttcgcaccatcttcattcgataaatggccctcatcaccaataattcgctgctttaatggccatggataccgacccatccgcaacatttctaagtcatgattacattcaaataaatagccgtcagcgtctttgattacaccttcaacgtgctctgaaacgtagcccgtatccgtaatgatgacaaacgattttccggcatgatgtagttcataaaattgtggctcggccgcatcatgtgacacactaaatgattccacgtcgagatcaacctagtccaagcgtcgtgttcgggtcaaagacatgacataattcggcgggaacgttgccgattttatgcgccattgcgtcccaggtcccctgattagcataaacatccataccatacttccgcgctaaaatccccgcagaatggcagtgatcagtgtgttcatggctaataaataaactatcgacttcattaatatcacgatcgatcgacgccattaaattagcaatttttttgccacttagccccgcatcaaccaatactttgtgctctggcgtttcgatgtatgtcacgttacccgtactacccgatgccagaatgcttactttcatatcatccgttgctaattttaataccattatttaggctcttcctatctctgaaatccattactatcttcatatgatacacgcttttagcggggttgaaaagcaagccacccgcaagtgctcaaacttaacgtccacgactatcgccatcacgcggttagtctagtttacgtgtcgtgtatgcgcacactagtttaccggccattaaactcacacgaaaccgcgaacatcaacgctgagcaatccacgctacgtcatgccacctcgacattggcgtatcacaactagtcaaaaatctagtcaccaaaaaacgggcctgttaggaaaaacactcttcttcacagcacccgttattcgacaacgacacctagtcgttaaactggttttcactaatcaattgcattccacatcattcgaccgtcgcatctaaactactcgtatcactagccgtactaccgttcttcattgaagaaccagtaaaggcattgatacggtgcagtgtaacgttagaactattcttaccccggaccgcaaagatccacgttgggacgtaaacactactatccttcaatttcaataaccgagaatacccaagctttgcccaaacgatccgggaactacttgccacctgattatattgatacaacgcaaccagggcctttttttcactgatcgtaacagccttttcgcgtaaagttttgacgtgattgacgtacgtctgagtataacttgtcagctgcttgtttttattaacaaataggtggacttgcccagcgccagtcatgatctcgccatccgcaaccttttgaacaaaaacgtaatcgccgttagacgacaaatccgcatcatagacgtactcggttccatggattacattggtccgctgactcataaacgtcgtcaagtccgctttaggattgcgggtatcgatagtggtggttgcccgtagtgtgctcacgagcttaccgccgctttgcacccgggctgtctgttcagttaactgactcaacaattgtttgagaccactctcgttactgcccgcaatatagtaacccgtcccttcgctcgtgtccgggtttttaaagctaatattatctgcgcgcatttcacgaattatcgtggtcgccgtatcaccagtcgtttgtgtcgacttagagctcgtttgcacgaacacataaaacccaagaagatatctagaacaacaaatgctagtaggaaaatccactcaattctccgaaaattcatgcggccacctcctaagatccacttaacatcgacgtatatgtccgccaagtgccattatagtagacataatacgtcggcgtcaggtcgatcacgagtttggacgacttgttctgtgaccattcgtagccaagttcaatactgccaattttactgtctttataaccagcggccttcagacgttttaacacacttgtcgaactcggtaaggtcaccgcttgcttctgaccagtagttggtactggcacccgcaaactgtacagtgagaagtagtaacggtctaacccgttagaagtgagctgaatccggacatcgccattttcggtctgattaaagatcgggaacccttcaacatagcttcggtaaatgacactattactcgttgcgtcaaaaccgtagtagcggatattatccattgggacaccgagacagtagttaacaaattgaagctcttctttagctgattagtcagtgataggttccgcgtggttcctgaatcactataatcttcgaaatacactgttcctagcttagaatccaccgtcatgcgcttgtaactacccgttgtatactcctgtttaccactgcgattatgcactgaaacggtcgaattaccatccgcatctagtaatcggttggcaatctcactcgcagccgctttactcatcaagtagctataatgttgcatcgtaacttgctttggataatcaatatacgttgtattatcctcataggtcatcttgacagcaatccgtttgaccttgtcgactgccaaaactttttcaacgacgacagagattttttcttcaaccgaacactataaatctcatgatggtcatcattcaaaaagtagatgtgattcgtatcattgactggaatcacgatccgactaaattccgaggagcgaaaattactgagatgttgcctgaaggaaccgtattaaacatactgacagtaatactgtcaggaaagttcaatacgtacgaatcagttccatttaagagcgcacggtagctttttgccgacgtaatgcgaactttagagatactccgcgcatcccatttgcgtaactgctcactaaattgactgactaagctgacatttttattaatcagcaggggattggccaccctgactgttagtgtgaattaattgtgtcggtaaataaatatcatcgattgtccgagttgtcaacgaagagttcgatgacgtcgtactaaccttgctttcatgctcatagcgtgacggattcaaccagatatacatggataaaaccacgctcaataagatcagaatcgtcaataaaatgggtaagataaagcgtctaagcttgtgagtcgtcatcccaaaggtcctcctcctcataaggttcgtatggcggggagatatagaacgtagaccccttaccttcaacactatcaacccaaatacgagccccgccgagcatctgaacaacttcttttgaaatcgccaaaccgaggcccgtcccaccttgggcccgtgaccgcgccttgtcgactcggaagaatcggtcaaagacgtgtcctaagtcggcccgtgggatacccaagccctgatcactaatactaatgatcacttggttatgcgtctctaacaggcgacaagtcacgacaccgccatcaggtgaatacttgatcgcattattcataatgttatccaatacttgagtgaatttatcggtatcaatttcaacccacagatcacgcttggtaaactcgcgcttaatagtgtaatacttagctggattatcatccttctttaagatcatatcaaaccgatcaagcacgtaattgaacatctcattaatattgaccaattccatatcgacccgggtggtccctgagtccatccgtgatagacttaagagttcattgatcattcgaatcatacgatcggtttcttcttgagtgaccttgccaaaaatcctggggccacttcaggatccttccatgcaccatcactcagtgcttcaatataactccgcaaactagtcagtggtgtccgtaattcatgagacacgttcgaaacaaattgtttccggtcattatcaatcttttgttgttccgtgacatcgtggagcacacagactaacccactaataaacccagactcccgttgaattaacgagaagtaggcattcaagattaggtcacgctcgttcgaagaaaaatcaagcatcaattcatcttgattttcaatcaaatcacgcaatgaataatcatcacggatttttaaaatatctaaaatcgagttaccgattgccttttcggccgtaacatccataaagtccgaggctgtttcattgatgatggtaatattaccccggcgatcagtggcaatcacgccatcactcatgtgtgagagcacactatccaaccggcgccgctcagcttctgtcgactcttgcgattcttctccactcgaatcgacaagttattaatggctttagccaactggcccaactcatcatcgctataaactcggacttgccccgcataatcaccacgggcaattcgttgcgtctgctgcttcatttcttcgattggacgagttattgcccgggcaataatgattgcaattcccagtcccaagaccatcgcagcaagtgacgcaatcacaaagattcccataatgttgttaatcgtactgtagacagacttcatatttgcccgtacatacagtaccccaactaactgactgctattacccgctgaattggagctatatagcggcacgattgaaacgtagtagcgtccattattctgagtgtcataggtacttttagtgtaagttcgattattatagatcgcattcttgacgtttcgatcggtcgttttttgtccaactactgactgatcattaacatcactcgtcccacgaattgttcctttgctgtcaacaacttggatttcaatcaacattcgtattgttgtagttcgacaaaatcgtcttgatttggccgttggccttgcgcgtactgctgacggtcaattgttcggacaacgaattatcaatataagttggaatttgcaccgactgtttaaaatcctggatgttctttgattccaactgtttcacaaagattgcacccacgatttccaacgtaatcaataatagaagggcaaacacgagcgcaattttgaaattaattgttttaaaaaaatttttccgtttaaatctcaacacggtttagcaacctctactcattttcaggattgcggagatagtaacccacgccccgccgcgtcaccagccattttggatgactcgggttatcttcaactttttcacgtaaccgccgcacggtcacatcaactgtccggacatcaccaaagtaatcatagccccagaccgtctgcaacaagtgttcccgcgtcatgacttggccgatatgttgggctaagtaatgtaacagttcaaattcacggtgcgttaattcgatgttttcaccgcgtttggaaaccatataagcttctggatggatcaccagatcgccaatttcaatgtctgaattttcttcaacttcagctggttgggcacttggtgcaccttgccgccgcagatttgctttgactcgagccacgagttcccggtttgagaacggtttggtcacatagtcgtccgcgcccagttccaagcccaacaccttgtctaattcagagtcctttgccgttaccatgataattggcatatcatagttcttccgtacttgtcgagcaacttccaagccatccatcttaggcaacatcaaatctaacaaaatcaaatcagggtggacttcatccactttttgtaaggcttcctctccgtcagctgcaacgtgaacttcatagccttctttggtcagattaaatttcatgatatcagagatgggcttttcatcatcaactactaagattttttttttttttcataacgattcttcctccttaggggaaaacaggtttacatttcaatttttagggtgattcgcgatatattacgagaaaacaggtcctttctcgtgtcagggttggttgaaactaaattcaacactggttttagtatatcacaaatgtagttggctttctttgattgctaatccgcgtggccgtagtatttcccgggaaatcatttgccagttcaagcaatcgttttcaccaatttaattactcaaaaatcacttttttgaaaaaactttcgaaatagtgttgtcagaactcaaaattcatgatattatatttttgttgagttatgggcagttagctcagctggcagagcaacggactcttaatccgtgggtccagggttcgatcccctgactgcccatcatataaccacactaatcagttttcacgccgtgataatccaccgtgaaagctgatttttttattcccaaaaaagcctcaggaagcacaacgcaaaaagtgcgtgtgacgtccctggggctttttctaacgatctaatgtttaccatcagtgtagctaagtaactcaattgctagggttattcttgatcaatatgaaaataaccttcaggagctgcactcggctgtgcttgatgccaatgttggctactacttccatatttagttggttgtggatccggtcccattgcaacaaagcgccggcccaatgcgtccataaaaataacgacccgctgatattcacgcgcaggtgcaactaacgtacaattctcatgcttaatgccgtaaacatctacaaaatccattccgaccacttagctttcttgtttagctgacaacccgtcacttcaaataaaaaccgaaccagttaatgataatggttcggcccaacagttactattgtggttgaacgttcgttgcttgggggccacgatcgccctgttcttcatcataagttactttttgaccttcatctaaggttttaaagccatcagtttgaatcgctgaaaaatgaacaaagacatcggtaccgtcttcacccgtaataaaaccaaaccctttatccgcattgaaccattttactgtaccattcttcattattagataagtcctctcagaactgactgcagtaacaacatcgttaaccttgggagcgccaatcaatcataacgttccacgcgttaagtggtttaagtatatcacatccctagtttttaatcgctgaaaacggtgtgcataacgtatgactttccccatgattcctgcatactgaggtgtaaaggggtgactaagtatgcaacacacgactcgtcaggcagccctacatatgatccaaaccgcccccgtcttcacgttagcaactgttgatgcggacggctttccgaccatggtagcgctcagtcccttacctatcaaacggagcctagaagaactttacttctatactagtcgtcaaacttcaacaacgcagaacattcaaaactggcgtcaagcgagttttattctattaccaactgtcagactatgcgtcaattatgcttcggggaaaactctcattagtcggtaccaacgtttttgaacaagattggcgggctgaactaacggactttcagcagcaactaaattacaaagaccccgtcattctcaggtttcagacaagttcaatcaagattcgccagatgatgacgatcgaccatctcgaactcgttgatcagcccactgacggccccgctcacttagattagccgttacaaattaggccttctcagaaagacacaaccgaagcgccacgactagattctacgcaaattctagttgtggcgcttcgtgctttggtcacccaacaactagcatggctcgaagcgtgatatcactttcaaaccagttattaatgcaagcacgtccgactattccggacgtgcatcaaagaccaagtatcatcagcacaagccagaacactttgttcattcaccttcgaaaacaacgccactttcaacctctgtcagcccctactttcatcaccaatatttgcgagtcttgtaaaaagagactaggctgtagttatggttaatatttttatatttaggattacttattgcaatttttaatgaccgaactaaggagtgtggacttatgaaacttattagattgcgaattgaaaatgacgcgatggatatcgcttatcatccagtatcggggcaagccgcaacggcccattacctgattgcctataattctgaccaaacaattggtgaaaatctagagaacatcaaggttcgcttagccggacttcaattcgatgctgctattcttgaaaacggactgtcctatccattctcagacacaatcgtcggtgtcaactatgatcgcattgatgtcgggctagctttgactaatttgcttaatatcccagtcgttagccaagctgccgttgatcaacttggactagtagccgcagttaaagctaaaagtgcctatttaaaatggcatttggattactacggccaataccacggtgtccgtaataatggtcaagaagccatgttgaccattggtaacggttattttggtctacggggcgcctttttggaaagtcacgccgacaaggacaattatcctgggacatacgttgccggggtctatgatcaaaccaccacgactgttcatgaccaccaagtgaagaatgaagatttagtcaatttaccgaacgctcagttcatgactttcggtattgatcatcagactccctttacactcaacgaacatgatttacaagatgcttatcggagccttgatttgaaaacgggactcttgacgaccactaaattgattcagctcgcttccggacatcaactcagaatccggtcgcagaaagtcgccaacatgcgtgattggcaccgttacagcattcgttaccaagtcaccccactcaactttgcgggtagtctacaaatctataccgaaatcgacggtagcgtcgtgaatagcaacgttagccgctataacgtcttcgatcagcatcatctgaagactatgggcatcgaaacggctgctaataccgtctacctttctggtcagaccaaatcatcacatatcaattacacgattggggccaaactaactagcccagacgttcccgcaattgagaactttaatagcacgcaacaacctcagggcgttcagcaaaccgtttcactggcggtagaagctggtaaaacgtataccttcgataagaacgtcgtcattgcaactagtaatgaccatagtgatccccagttgacccacgtccaagccgagctcgaccagtccagttttgacaatacggtaaccactagcaaggactattgggaagcgacttggcgcgccacagatattaagatccgtggcgatattacaagccaacgcttactgcgcgtcaatatttaccacagtttcgtttccgctgccgcaattgaaagcggccaattagacgcttccgttggtgctcggggctccacggacggagaagcttaccggggacacgtcttttgggacgaaatgttcattttaccattctacacgttgcaccgaccggaactagccaaacaactcttagcttatcgttaccggcgactaccaatggcgcgtaaaaatgccgaagcagaaggctatgcgggagccatgtacccctggcaatcagcatccaagggtgatgaacaatctcaattcactcacttaaatcccattactaaaacctgggatccagataatagccggctccagcgacacgtctcgttagatattgcctacaacgtctggttttactaccacgttactcaggaccgtgatttcttaactcattatggtatggaaatgttgctatcgatcgcagccttttggatcagtaaagcagattatgaccaagctaatggccgttataacattagtggggtcatgggaccagatgaattccatgaaaactatccaaacagcacgaccgctggattgaagaataatgcctataccaaatcatggttgcgtggctctttgacacgatcaccatgcttcgggctcagatgccccaagctgcttttcaagcggcagctcaggccgcacaatttgactcaacggctgagcaagcgttaacgacgatcagtcatcaattaacacttgaaatcaatcgtcggggaatcattgctcaatttgaggggtacttcaacctaccgacgcttgactttcaagcttatcggcaaaagtacggtgacatcgcccggatggaccggatcttgaaagcagagtctaagacacccgatgcttaccaagtggccaaacaagcagacgccttgatggccttttataacttcgatgtcacaactgttcagaagattattgaaaaaatgggatatcaacttcctaaagagtatctgacccataacattcaatactatttagcgcgcacaacgcatggttccactctctcgcggatcgtttacgccgttttgaatcagcttgacgataacgaccgatgatgcctggaagcttttctcagaggccctcgcatccgactattacgacattcaaggtgggacgaccgctgaagggattcacctcggcgtcatgtgtgcgaccttaaacctgacgacacggaactttggcggggtcaatccactaggtgcccacttacaggtgaacccacggctacctgaacactggcaaacattgaaattcaagcatctctttcggggtgttcactatgttttcgttatcgatcatcaacgggtaaccgtcactgcggaccaacccagcacgattatgattggaaaacagcattaccaattacaagctaagaaaccactttccgtcacttataccgattaatctaggaggcaatcaacatggttaaatttgcagcaatcaaggggtttgtctttgacctcgatggcgttatcacggacacatctacttttcatagccaagcttggcaccagatcgccgataaagtcggggtcagttggaatgatcaattagctgacgcgctcaaaggtatcagtcggatggattcactcaacctcattctagctcaagggcaccgagaaaatgacttcacaccggcccaaaaacaagcgctagctacggaaaagaacaccaattatttgcagctcgttaaccaaatgaccccagccaacattctaccaggcatcaccgcctttttgactgaattaacaacggctggctacgcattgtcactcgcttcagcatcaaaaatgctccgcttgtgctacgtaaactcggtcttagtgactactttacgaaggccgtcgaccccgctagtctcaaacacggtaaacctgatcccgagatttttcggcgcggtgctgagattttaggccttaatccagctgactgtattggtgtcgaggacgcggcggctggcgtacaatcgatcaaaggcgctggcgaaactgccatcggtattggtgacccgaccgttttagcggcggcagatatcaattttaccgatataccgactcagctcacactcgccaatattaaggcacaactaaactaacgtatttccattaaactcatcacaaaacaaaccggatttggcgaccacgtcatggttaccaaatccggtttgttttgtttaagccagtcgctaatctcaccagttggactgctcactggaagcttataattatcagactagctgtcaattctcaaatcaaatcaaaatgttgcaatccttgggcaatcccgccgtgcatgttgtcagcggtcacgtaccgcgcgagttgtttgaccgcggatgaccattgcccattgcaatcggtgtctggatcattcggaacatctcaatatcatttaattgatcaccaaacgcataggtcggtaccttagttaaatgcgccttggttaagatatcctgaattccaaccgccttggagacgccccattgcatagtgtccagcgcacgcggattattacgaacaaaatgtagtcggcctcgatatcgctgccgatattgcgccgcattcaacggatcaaacgtcagtaagaaattaatatgttgatgttcaaaaagtgcggtgcgacccgggccgtctgtctgagtgcccgataattactggttgtcaatgcatcacgatggcttaacgcaaaaccggcgttattataataagctagcgcattctgttggcgattggcaaaatgagtaatatcggtcaaaagctccttatccagttcgtgcgcactcaaaaactgcccttgatacgcgacgtaactcccattcgcactgacgattgaatcgatccccgtcgttgtcatcacatcttgaacttcgaatacattgcgacccgtggcaatgacgggtaggacgtggttagctcgtaattgctggattgcccgcacactgctggccgcaaccgtcttatcgtcccgcattaacgttccatccaaatcaaaaaacactactgcttggtacaaccaattacccctaattaatcagtcactggccaataaaccagcgccaccaatacactaattaccttcgtgatgacgtctatttaaaaccatccgaaaaggtgctttagtgtttacctttattataagcacctcgtctgaacaacgcagacattctgcttataagcgcacaaaaatgcgtggccaatcaaggaaagccacgcactaatgtgcctacgtctcattaaggatcgatgagtacttcgtaatacataatcaatagcggggtgctattaaaaagtacaattatactatacggctgaaccgtactaacaatcatcaagttcctgtaaaatttaggtaaagttttcaataaggcgcaactgttcaccacccagcgtctgcgtcacaagggagcgttgaatcgcttgtgctaattttatgggcacaccactcaactttaaatcgtgactcgtcatggttcgcggctcagtagtcacattgacaatcaccatcacggtctgatcagcccgccaataaaggtagccaatgccataattctctgccaagtaaaacggcacaaagtgggctgtgtttaaccacgggtgccgttgacgccaattcgcccagtcagcgacaaactgaacttgcgcctgatctgcgtcccgccacggataaaacgcacggttatcagggtctttcccccatcatcaacgcctcatcaccgtaatacaggcacggtacacctggaagcgtcaagagtagttggacggccaaacgtaggcgttggcgatcttcggctaacatagtcaggattctgggcgtatcatggctaccgatgttattgaagttaaagcgaaacgtcgtagcgggataattttccttgagggtcattagttcacgccaccattcggccggtgttagcgtgccgtttaaaacgtgaataatcaagcggcggagcggataattcatgacagcctgtaagccgccgccctctaagtagtgccggcgcatcccatacgctaatttatgagaggcatcctcccaaacttcaccgatccaaaaccttatccggataacggtcaagggtccgtcgaattccagcaatgaaatcgtctggcaactcatccgcgacatctaggcgccagccatccacaccgcgttgcgtccaatagtcaatgaccgaatcgggtttacaaaagataaaatcgcggtatgttggatcgtctttatcaactgtcggcagatcacggatgccccaccagctatcgtaatcgtggggataatgaatgaatgtgaaccacgggtagtacggactcgtggtcgactgagttgccccaatcgtcgggtaatggcccgcctgattgaaatacttagaatccacaccaacatggttaaaaacaccgtctaagatcagtcgcataccggcccggtgtacggccgcgaccaggttatcaaagtccgtcaaatcgccgacgaccggatcaatcttcagatagtcacccgtatcataccgatgattactgctggcctcaaagatcggcgtcagataaataattgtcatcacaccgagtcgctgtaaatatggaatcttagcactaataccgcgcaaattaccaccgtaaaaattccagcgtaaaatcgcccagtgttcatcacgcacgtatagtgggcgatccgttagttgaccataaataaagctatttggcttgggcgcattaacgtggccatccgcgttgccattattgaagcggtcaacaaagatctgataagcaaccccttcacgataccattgtggcaatgtttctactgctttcaagattgtcaattgatacatttgaacatgctcgcgcaagacgtattgaacgcccgggccaccataaccaccatcaacgcaaccataataagcggtcatggtcgccgtttcaatccgaaaatagtagaagtacaggccaacctgggtcggtataaacgtggccgtatacattgtgggactgattggatgtaacggtaaggcctgttcatcatcccactgaccatcatgagccacgcataaatcaatctggtgcttaaccggcgttactgtctgaacactgattgtgaattgaacgggtgtctggcgggtcacggcaccaaagggtgtcttatacgtgggtaaaaatgagttatacgttacccgcatccgtcacccttcctttcttaattcagtcgttcgtggggcacttgccaaatatcgtcagcataccgcgccactgctaagtccgcggcaaagtgtcccgaagcggcaatgttggctaacgagcgttgttgccaagtgggttgattttgaaaatcacgactgatctgctgttgttgggtgacataagcccggtaatcggctaagacaaagaattcatcattataccgcagtaatgaatcatagatttcccgaccaaccgttggaattcccggaatcgtgccatcaatcaaactatctaagagccgttttaattcaggatcagcatcgtaaaagtcagcggcgtgatagttgccgcgatggtaatagtcgtacacttcattgaccttaagcccaaacggatattcattttcagcacccgccgcttgcataatgtcgatattcgcgccgtcatacgttgccaatgataatgcaccgttgaccatcagtttcatgttactagtccccgacgcttctttggaggccgttgaaatctgctcgctaacgtcggcggcgggaatgatcagttcggcaatggagaccccgtagttcggaataaagacgatctttaaccgatcaccaatcgccgggtcctgattcaccatgtcagcgacgacattaatgagtttgataatcgccttggcatagtgataactaggagccgccttggcaccgaaaatgtgtactcgcggcacgactggctgttgcggatgatccttaatggcaaaatactcgcgcaagatttcaaagacgtgtaggagttgccgcttataagcatgcaaccgtttgatttgaacatcgtaaatcgcgtcggtgcgaatcttgatccccatagtacgctgaacgtacgctggctaaagcttgcttgttagtcagtttaacttgacctaactggtacaaaaagtgatcatcttgttgatacggcagtagcgtctgtaataaatctggttgccgccgccagtccgaaccaatcgtctgatcaatcaattgcgctagtggttggttcgccaattgaacccaccgccgggttgcaatgccattcgtcttattattaaaccgctccggataaacttgatacaggccccgtaacacatccgttttcagtaattccgtatgcagtggcgcgacaccgttcacactgtgactcccaatcacagctaggtaggccatccgtacttgtccgttgcctaaaggcgccgtctgatcaacgagcgctttgccaaaaatcggcgtttgttgttcccggtagcgccggtcgatttccgcaataatctgatagatccggggtagcgggtttttaaacatatcgattggccaagtctcgagcgcctcttgtaaaatcgtatggattcgtgtaactcatgacttgcgtcgttaacgtccacgcgacttcccatgaacagtgatgttcatccattaatagccgcatcatctcagggatcaccagcgtcgggtgcgtatcgttaatgtgaatcgcgacctttttgcctaacaatttgatgccatggtgcgtcgcacaaaaatcacgcacgatactttgaacacccgcagaagagaaaaagtattcttggcgtaaacgcagttgttgcccggccgagttagaatcgtcaggatacaagaccttggtaatctcactgattcgatcacgctgatcccgcgaagaataggtcgcactgggtggtaactccgcggaccacaaacgcaaggtgttcgtaatatcgttgtgatacccgacgataccaacgtcgtaaggaaccgctagcacgtcttccatattttcagattgcggttgtaaccacacattgccgccgaactggacaatgcagctcttgttatcgcgccgggtctcccacacgttgccatgatggagccaatcatcgggtaattctacttgatagccatccatgaaaacttgtttgaacaagccgtaacgatagcggatgccgttaccgttgccggcaattttcaaactagccatcgcgtccatataacaggctgccaaccgacctaatcctccgttaccaagcgccggatcaggttcagcctgactgattgtctcaaagtctaagcctaattccgttagcccttttttaccgtcgtcaataagttgagattcaacaaattagaagcgagtaagcgtcccggcaagaactcgatggaaaaataatagacttgtttctgatgatggtcgcggtaaaatttagctgttcgtgtccaactctgactgttatagcgccgaactagctgtcccagtgcaataaattgcccaatcgtcgaggtgtcactcagcgatgttgaatacaaggtctcaatttcacttagaaagtcctttttaaattgcgcacacgttaatttcaaattcacacccccatcaaacctaacgcattagcttctgataagtcgcacggtactgctgtgcagaatgttcccagccaaaatcacaagtcattgcttggtgctgcagctgccgccaaaccagtggatgctgccgatataaggtcacggctagaaccataattttacgtagaaccgctggctggtagtcgtcaaagctaaagccggttccctgatcggtatagcgattgtacggaatgaccgtgtcccgcaacccaccgaccgcgtgcacgatcggtaacgtcccgtaatgcatcgccatcatctgcgacaagccacacggttcaaaggcagaaggcataagaaagatatcactggccgcatagatttgctgagctagctgcgtatcaaattgaatcgcggcgaccacctttgcggatacgccgactgataggtgcgtaacgcgcgttccaatgctgggtcacccgttcccaaaacaatgagttgcacatcttgttgctgcaagaatggattcaatgcatccagcaagaggtcgatacccttttgcttcgttaaccgagaaacgactgccaataccggcacgtttttgacaggcaaccctaatcggcgctgtaaagcacgtttattctgacgcttaggtttcaaattcttagccgaataattcgccgttagtgccaggtcggttgcgggatcgtataattgcatatcaatgccattaagaatcccactcagtttgtaccgattggcccgcagcaccccgtcgagacgttccccaaaagctggtgtttgaatctcttgtgcgtaggtcggtgacaccgtattaacggcatctgcaaagttaataccgcccttcagccagttcacttgatcgtaaaacgccacgccggcttcggtgtaagtctcagttccgattcgaaagagactatccaaaataatcggatcgtagacaccttgaaactgtaagttatgaatcgtcagcaccgttttaatatcacgatacgcttcgatccaatagtacttttccgctagcaagacaggaataaacgccgtatgccaatcattgagttgtaaaatatcagggatataatcgatccgctccatcatttcacaaaccgccatctgaaagaaggcaaagcgttcaccatcatcccaataaccatataatccttcacggccaaaataatctaaattatcaattagataatactgaacgtgcgcgactgtcagagttttaataccgcaatacatcgcatgttcacccacttgaacagtaaaatgcgtcactggcactaactgctgctgatattcggtcggcatctggtgagggtaatacggaatcactacacgcgtctcgattccttccgcttgcaaggcgcgcggtaacgccatactaacatcgcctaagccaccagtcttataaaaggggccgcttctgccgccgcgaataataccctagtcatgcacagccacctccgcttgttgaaagacgtgctgccctttgctgatgactaacggtgtcgttgaagttcctttaagcactaggttgggcccgattacggcgtctttatcgataatgacgttttctaacttacaaccggcaccgatccgggccccctgcataatgatggcatttttaacttggctatcacgattaatcagtacatcccgaaagatgacggagtggtcaagttgcccttcaatatagcccccagtaccacataaactatcacgacactgtgaaccagtcgcaaagaacgtcgggatttcatttttgaccttggtgtaaatacggcgcgaactgtagaataacgctcggaaattagcttcatccaaaacggccatattggccgcaaagtagctgttgatatcatgaatattcgcctgaaagcccgtatattcaaaagcattagcgttatgttggatgactgcttgccgcatcaattcctctaggctgatcatgtcaccccgttgattggccgactgcaattaataattcgattaaatcgaccgtactcatcaagtaaatagccatgctcttggcaacttgtttcgtcttcgggctaatcttggccttgctcatcggaacgaccgccgttgcttctcccttagcagtcaattgtaagattgtattttcgggaatcaaactagctggatcaacgcgcttataaaccgccgtcacgggactgttacgttcctcgtgataccgtagtagcgcctttaaatcaatattaccgacattgcgagtactcatcactaccgagtactcactctggctgcatttcagaaactgaatcgaattatcatagtaatggtgcagtaatgcggccttcttttctggcgccactaatttcaagtcattgtatggggagaagaataggccgccgcgaattgtgttcaggctccagtcacgcccgctacgcaaatggtcagccacggaacgccctgaccgcgggaccgtcaccatcacattttgaatccccgcattgatgagcactcgataattgaaaatcaaccaaccgataacgaccaccaaagggtaacattccaactggccgaactgcagtcaatggttgtaacgcgtcacttggttccagtaaattaataatggcactcacttgttcacgtctcatggttgttccacccccatcgtttcgtgatacccaacaactgcaatcttatcagtcgtaccaataatctgggcatcatcaccaataactgcatcttcgccaatcaatgcgtggtcaatcaccacattttttccaatcgttgcaccgggcataatcatactgtcgaccacgcgactacccatcccaactgacacgcgttgcgataagattgaatgatcaatttcgcccgcaacgtaacaactatcaacgaccatggcattattgacctggctcgtttccgtcaagaacatcggtggtagcacctctgctttagagtaaatccgccagtaacgatcgccgatatttaaccggttatggggcgataggaattccatattggcttgccacaggctcttaatcgttccaacatctcgccagtaacccttaaaagcataagcgtaaacggattcattattggctaagtatgatggaatgacatttttaccaaagtcttcaagtgacttatcggtagcataactcttaactaagtaatcccgcaaagtcggccaattgaagatataaatgcccatcgaggctttatcactcttaggatgttccggtttttcctcaaactcaatgattcgatccgtcgcatccgtattcatcatgccaaagcgtttggcttcttcgttagtcacgtggatcaccccaacggtcaacgaagccttcttctcctgatgatatttcagcatagcgtcataatccatcttataaatatgatcgccagataagacgagcggtacttggggtcttgttgatcaatatattcaatattttgataaatggcgtgcgccgtcccttgaaagaacttctcaccttcactagacgagtatggttgtaaaaccgtcaccccaccatttaagctatcaaagccccagctcgcaccgctaccaatatgtgcattcagttctaggggttgatattgcgtgataaccccaacggtattcacacccgagttagcacagttgctgagtgtaaaatcaataattcggtaacgaccgccgaatggcacggcgggcttagccgtatccttcgtcaacttaccaagccgggtgccctgaccgcccgctaaaataatccctaacatttcatcttgcatgcttaactcccctatcactttaactggtcgaatcaacaatgcacccatcgccggcaaggtcacggtaaaactagctggttgcccccgatacggcttatcgaccgccgtaaacgttgtttctagctttgtccacgtgccgccaaaagcacgcgcttcagtgttgagtaacaactcataacggccacgatacggtacgccgatccggtaatcttgacgttcaacagggaacaaaattgaaagcagcgaccacaaaactgtatttccgtttggcgccggataaaccccatggtcgaactgtcaggatcatcggtatgtgtataaataatccccgcaggatcatggtcctgttcccacaacggccgattgtgccgatagaccgcgttcagttgcgttgtgaactgttgcatccgatggttgagatcatcctttaagtcgacccattccaacgcactccagtcccgccactctaggaactgcccccactctgagcccataaaattcagttgttttcctgggaaggcagccatataagttagcatcgtccgcaaatttgcaaactgattatagcggtccccggcattttatgcattaatgatttcttgccgtgcacgacttcatcatgtgaaaacggtagaataaaccgttcatcgaacatgtacacgaatgcaaatgtcagtagattaaagtggtcgtgccgatataacggatccatcatgaagaaatccagggtatcgtgcatccaccccatgttccacttatagttaaatcccaatccgccattggccaccgaacccgtaacctcgcggataggcggacgactcttccgcaatcatcaagatatcgggatggtgggttaagaccgtggtgttcaacttttgtaaaaaggcgatgccttctaaattacgattatccccatactgattagcgcccttcgcgcccttcatcatagtcgcaatacaacatgttagagacagcatccactcgcaagccatctagatgacactgatcgagccaatattcggcgcttgaaatcagaaaactctgaacctgtgttttaccgagatcaaaattccatgcccccaacgacggttattcgcgcgctcaggatcagcgtattcaaatgtcggcgtaccatcatactggtacaacgcatcataattgcgaataaagtgacccggtacccaatcaacgaataccccgatattcgcttggtgacacactggtcaacaaagctgagaaaactgtcacgcttgccaaaacgactggttggcgcaaaataccctaattgctgataaccccaagacgcatctaacaaatgttccatcacgggcattaattcaatgtgggtatagccccgttgttttacatagggaatcagttcagcggctaattccgcataagtgtagtagctaccatcaagatgacggcgccacgaacctaagtgcacctcataaatgttaattggccgattggcagcgcgcgacttcttccggcgagctagccagaaactatcgtgccaacgcatcgtcatcggctcaacaactacggccgcatccccggttttcgttcgaactgttgtgcaaacgggtcaatctttagttgcacttggccagttggtgttgtgatctgaaacttgtataactgacccgcatgaacgttcggaacttgtccttgccaaatccccgtcgcccctaataactttagtgcgcttggttgccagtcattaaaatcgccaacaaccccgacagccttagcatgcggcgcccagacgcgaaataccgcccgaccagatgcgcccaaatgacagcctaagtaatcctgactattaaatcctgcgccggtattaaataagtaacttgcatcattcatttccgtagtttgtttaaccaaagcatcacacccctatgtgattaactgagcagattataaaattaatcttattataagaaggtgacagggtgtttgcctatccttgataaggtcgccttacctaatgatcaaacagggcacaagcccctaaaagataacgattattatgactagtcacccagaccgctgcaaactgattcaggacaactattcacagttaagcccgtggttatccgttttattgcgccgtttgccaaaacatcaaaaaagcccgaaaaacgcgttttttcgggctagttgatttattcaattacatttctatcaaattaataatatttatctgactgattacttccagtaggcatagcgataaagggcgtctcgcaacaatgtgaagtgaaccccaccaaccttgttactgatcaagtgagcagcagcagtttgataaatcggtgtgaccccctgttgctgagcgactagcttagccgcttgctgcatcgtctgatatcgggccttagttgactgcttatcggccgtaatcgttgagattaattgctcatatttcgcattgttaaacttcccaaagttgacagaattagttatcgaagccttattcaagaaatcaactggatcttgaaatcactcgaccacgacaacgtggcaaagtcaaaatcacccttgcttaaagttgaaatctcatttgtcagtggtactgacttgacattgaccgtgacaccactaagatttttctcaattgcagcttgaatatattctgccaccgacttattaatatcattatcgttcgtcaataattgcagtgttaacttttgctttcctaagcatttgcctgagccttctgccaatactgtttagcctttgctggactgtatggatacaaatttccggtatccgtattaaaatctttccctgttgtcgggttcttggtattgccagcgggaactaatgacgtcgccgctactgagccgtctttgagaacgttcttaaccaatgactggcgattcaaagcgtaactcacagcacgccgcaagtcagtattctgcaatgctgagcgcttctggttccacaacatgaagtagagttgatttaacttcgtaaccttcatctgactttttagtgacccttgctcagctgccgatacttgggtgcccgtaatctgggtgacttggacctcattgctttggaagaggttctcggccgtactgttatttttgaccgtctgcaccttaatattcttgattcggacctgtttacggtcataataatacgggttcttcacatatttccacgtgtcattcgtcccattccaactcttcaagacatcagggaccattagagagcgttcgctgtgccgatgtcccatacttattcccgtatttctcagtaaattgtttgtttaacggatagatctctgtggctagccgataattaaaatacggcacgcgctgttgcaatgtaatttgtaacttatacttacccaacgctttaacgcctaaggtcttcaccgccttcttaccagccgtgattgctgttgcattcttgatttcagcaacgtgtccgacttcctgtgacttggtattcggatcgacctggcgttgcacggaataaacaaagtcagcggccgtgacctttttccattcgaccacttggcattgtgccgcaaattaaaggtataagtcttcccattattagtcggtttgacgactttcttggcaattgccggcacgactttccccttttgattagttgtgtacaagccttccataaactgagcaatagcggcctgactagcgatatcgtcggccttattaggatcagcggtcgcaatcgactgggtcgccgttacgttcaacgtcttctgctgactactctgctggctaccgcagccagttaacactaatcctagggctacaatagcaatactgctgatccatattctttttttcatgaatgatgactcctaacttaacgatgatgtcggttactggcaacgatacttcgattggcgccgacaacaacacatcaacggtaagcctccgttatccgtggtaaaccggtaattactggttttcacgactacaataacgttttgcaatcctgcgttcatcatcatgattcctccccttagattaaaaactaattaagataagattagcttttaagtttacatctgtcaactaaaagtttcgctcagcattctaagtcaccatggtattatgccttcactattcaggccgaaactagcttgcgcttttgaaccaaacgtatggtacgcgagcttaaaactagaccggctatgtcgggttatcaaatcaagaagtcaaaaacggataaacacttgtcccccaatcggcaataaaaaaatcgctattagccgatatactgactaataacgatacttgctcatcaatggcgaatctgaccattgccatcaatgacgtatttataagatgttaattccgctaatcccatcggaccgcgagcatgtaacttctgcgttgaaatcccgatttcagcgccaaacccaaattcaaagccatccgtaaaccgggtggaagcattgatataaacacacgctgcgttgacccgttgctggaagagcttcccagcttgataattatccgtcacaatagcttcggaatgttgggtattgtaacgattgatgtgcgtaatggccgctgcttctgaatcaacaactttcactgcaataattaaatcattatattccgttccccagtccgcatccgttgctggaaccacatcaggaacaatggcttgagttgcggcatccccgcgtacttctacgccttgttcacgaagtgccatgaatcatgctaggtaaataatcggccgcaacctcacgatgaattagaagcttttcagtggcgttgcaaactgatggtcgctgaactttcccattgatcacgatatcggttgccatttgcaattgcgcgtctttgtccacgtatacgtgacaattaccggctcccgtttcaataacgggtaccgttgctttagccaacaccgtttgaatcaaacgggcgctcccgcgtggaattaagacgtccacgtaatcagtgagctgcatgaacttagccgcagtcgcatgcgacgtatccgtaatcagttgaatcgcattctcatcgaccgcttcggcccgtaatgcaccacgtaagacttggacaagtgcttgattagagtgaagggcttccttaccaccacgtaagattacagcgtttccggttttaaaacacagtgctgatgcatccaccgtcacattggggcgcgcttcaaaaatcatgccgataacacctaatggtacccgttccttggcaatcatcaacccggcctcgttgcgccacgcgcggtccacatttccaattggatctggcaaactcacgacctgtttgagtccggtcgccatatcctggatgcggtctgctgttagccggagccggtcaacaaacttaactggtacttgcgggttctctaaatcccgcgcattagctgccaatatctcatcttgatggctcgttaacgccgttgccattgcggtcaacacttgatttttttgcgccgttgaaagtaaccccagcgtatagctagcttgttgagcccgctgacccaactgttctaaatctaccattttgataacctccccaacttaaccgaatagcgttccgactggttcgcccgctaaaatttgaaaaataattgtgggatccgcaccattggctaaaatcatttgaccattcgcatcgatcatccgttctgccgcttttagcttagtgaccatcccaccagtaccaaaccgactgccactcaccgccagctagcttataagtatgttgatcaaccttctcaatgtgccctaataactgggctcgggcatccgcattgggattaccatcataaaagccatcgatgtcggatagcatgattaacaaatccgccccgatattcgtggccacgattgcggatagttgatcgttatcaccgaactttgtttcatgatccaattcatcgaccgcgaccgtatcattttcattaacaattgggaccacgttttgttttaatagcgcctcaaatgtattcaacacattatggtgactcttaggataaacaaagatatcacgtgttaataacaactggccaattttttgttcataaatggcgaaacgttctttgtaaatcgaaatcaattcagtttgcccaatcgccgcaatcgcctgttgttcaggaattgcttttggacgttgcttgagtcccatataattcaagccaacaccaatagcccctgacgaaaccaagacaacttcacgcccccacggtgtcgcattgcgctaataacaaaggctaattgatcgattgcccgtaagttgatcgatccatctggataaactagcgtgcttgtcccgactttaatcacgactcgtttagcctttagttttcgtatcactttcactactgccaccaacttctctaattattttgtttcacgtgaaacatcggtctgaacgtccgtcttcatataattaacggccttgcgtaaattaaagtgaacgacaccgatattaactgccaacacgatcaataaaaccacaaatgccaacaaaaacagcaccttataagaccaattatcgataatcacaccaccaaataacggccctagcgagcgccctaacgcacaaaaggcttgtactagtccttggtaacgccccttagcactaactggtgataactgactcactagtgttggcatggctggtgaccaagttgcttcaccaatcgtcaataaaatcatggcaaagataaagtgtgggtataatcatgcgcaatcacaagtgatagaaatgataagcccacgaataacatgccgaagaaaaattgattatataaatttttaatccgattccccagcaaacttaaaatactctgaataaggaccagtaagcccgcgttgattgtccatagaaaactgtaattccgcagcggcatccccaaattcgtcatgtagacggataaattgctgacccactgttcgtatagcaaccagataataaataaactaataaagaaggtccagacaatgtgaaaattggcccgtggcaagtgcacatcttgtccttggcgcggatcaaccccggtcacgttcgacgaatccacattgtattcaaataatgcaataatcaagaaaatcacgaagaggctcgtggtcatcgagaatagcaaggccatccccatgctatacacgataccaaccagcatcgtgccgaaaacaactccgagattggcagcgagatacatcaacgtaaacgttcgcctgcactttatcgcgggggacactggcagccaaagcattaaacatcgtatttagccagccactagcaaacccggtcacgactaacaacatcggataccacggccatccatgaaaaagatcagagcaaagttcgcgaggccattcaacgtgattcccatcagtaacaggtgataaggattacctcgatcaaatatacgcccaccaatcgtacttgccaaaacgttggcaactgaattgagcatcaggacaattccagtctccgtcaacgacttacctaacacattgtgcatgtagatcgtcgttaacggccaaatgaaactcataccaatgttattcataaactgcccggcaattagccacggcgttttaatgagttgcttttgtgccacgccatcaccaccattattaaatctgtctacttttcatcatagcaaagtttatttaaaataacagggacatttatctcactaactcatcattatcacggccaaattggtgcatcaagcccaaccaattggcggaaaacaagtagcctcggcacgtgataaacaaaaattcctcttaattagtttaagaggaatttgataacaaatttattgatcgactgcaattaagcttggggatcccgcgcataagagactgaggagaacttattaaatggtttcacaaataatagtttgaccgttccccgcgccccagcacggttcttttcgataatcacttcaacttcaccaacatcctcagaagcatcttcgtcccgcggatcgccgccattaaagtcaccaccgccaccaaaattaccgccatcatcatcgtcgccgccttcgcgatcataataatcttcccggtataggaaggcaacgatgtcagcatcttgttcaattgaacccgattcacgaatatcggaaagcactggccgcttatcttgacgctgttcaacaccacgagatagctgtgataaggcaatgactggaacacctagttccttagccagtttcttcttccatttgccgcgaaatttcggaaacttcctgttgccgactttctgtgttactaccttcgatcagttgcaaataatcgaccacaatcaagccgaggttaccttgctctttcgctaagcggcgacttttggcccggatttctgacatcttgattccggggtatcgtcaataaaaatactagctttagacaaactccccatggcaaccaccaagtgttcccactcttcttcgttcagttgccccgtccgtaaatgcccagcgtcaatactaccttctgcacacagcatccggttgactaaggattcggcacccatttccaaactgaaaatggccactgtcgtatccgttttagtcgccacattttgggcaatattcaggacaaaggctgtcttaccaacggctggccgggcagccaaaataatcagattatccggttgtaagccggcggtcattttatccagctccgcaaaaccagtcggtaaaccggtaatgtcatcatcattttgatacaagcggtcaatttcttcaatcgacgcgttcaacacatctgaaatcgacttaaacccactctgattacgctgttcagacacgttcataatgtcgcgttccgcgtcatctaataacgtggtcacgtcatcattttccgtataggccttttgcgtaatctccgtggccgtcttgatcaaccgccgcaccgtcgccttttgcgccacaatcttagcatagtagccagcgttagccgcagtcggtacggacccagctaattcagcaatgtagctcatcccaccaacatcatccaattgattttgggccgttaataaatcactaacggtcaccgcatcaatagcctcgtcacggtcatttaaagtcaccatgctggcaaaaatgatctgatgtgcgcgccgatagaaatcttgcgcttcgacaaactccatcgcttccacgagggcgtcactgtttaagaaaatagcccccaagactgccttttcagcttcaatatttttgtgtggtggggtttgatccagcacatcgttgttcatttgtgatccgtccttttacttttcgacaacgtgcacgcgaatttgcgccgttacttctggatgtaacttaacgggcacgtttgtgtaacctaatacccgaattggttctggtaattcgatcttgcgtttatcaagcttaacttggtattggtcagctaacgccgttgcaatttgtttgctaggaattgacccaaacaaccgaccatcagtaccagctttggccttcaattcaacaaccgtttcatcagcttccaaaactgtcttgacttgcttagcttcggctaattcctcagcggcacgtgctgcttcagacttctgttcagccttcaacgtattgattgccgctttagtggcttccttggccaatccctttttaattaaaaagttctgcgcgtaaccatccgggacattcttgatttggccccgcttgcccttaccacggacatcattcaaaaaaataactttgcatttagactcactcctaattagattctgtggtcggctcatcagttgccgttaacaaatcaatcaacgattgtttgacggcttcaactgactgcccttcaatctgggttgcagcattcgataaatgaccgccaccacccaacttttccatataaacttgtacgttgatctcaccaagtgatcgtgccgaaattccgacccgtccatcttcacgacgtgtaatcacgaatgatgcgtcgacaccagacatagataatagtgaatcagcagcttgagccgccgttactgggtcatagacctgatcatcttcaccaacacataatgccatatcctggttaacaaattcaacggtttcaatcagatgattgcgttgtagataactatcaacgttctccttcataaattgttgaacgagtaacgagtccgcaccggctgatcgtagataactagcagcatcaaacgtccgcgatcctgatcgtaatgaaaacgacttcgtatcgtataacgattcctgtcaacattgcggttgcctcaatcttattgattggttcggcatcgtgcgattgatattcaaacatctcggtaatcagctcacaagtcgacgaagcatacggttcaatataaaccaaaactgggttttctggaaattcttcgccccgtcgatggtgatcaataatcataacgcgattttcgagccgctcataaagggcctgtgacattgaaatacttggcttagaatggtcagccataatcaataaactttggtcagtggccttctcaagtgcttcttccggcgagataatcgctgactcgatgttctcatcagacttcaactggtccagtaagcgctgaatgtctgaatgcacattttgctcatccaagacgatccaacactgtttaccattcatttcagcaattcggcgaatcccgagacaggccccaacggcatccatatctggttggcggtgccctgaacaaagatctggtcagattgattcattaactcttgtaacgtctgactgatcatccgggcccgtacccgcgtccgtttttccatcgggttggttttaccaccgtagaaacgagcgagttcgtcctcagacttcaccacaacttggtcaccaccccgccctaaggcaaggtccatgttactctgcgctaaatcggccaaattgttcatgttccgttcaccataagcaatcccaatactcaatgttagtgggaaattttgcttagaagtcgactcccgaattcgatctaaaatgcgaaatttattctcttcaacacgtcgtaaactactagcatagcccaacaagaagaagtgatcatcatccaagcgcttcaggtacatcccaaacatctgggtccacttagacaattcattggtcacgtaattgttcaggttggaaatatccgtatcagtcatcgactgggtgatttcatcgtaattatccaaaaagatttgtccaatcacgagtttttcatcttcgaattgatcccgtcagctcagcatacttggtcacatccatcatatagaccgtattagtgctctgctggacacgtacatcaaactggtagtcttgccaacgaatcgtcgcgggctcgtccagatgagcgttcagcgtcgctgccagtgttggctcaatatcttccaagcggtatcctaagacgtccttatcaccgaaatagcgctgaagataaggattgatccattcgatggtctggtcggaattaaaaatcattactccgataggcatctgaatcagtgcctcttgttcgccgcgcttaatacgatacgacaagtctgagatatattcatttgcactcgaactgagctcaatcaacgtattataagatatcaccacagccatcacaatcaagatgaggacaacggtcccaaaaatccagttcattaaataaccagtgacgagcataattaacgacaagctaaaaataaccaacgctaagagtcgtaactgctgattttgtaggaaaaaattggaattttttcacgcgaaaagatctttttcatattaaaaatccctcaagccttctcagtaatgactatattttatcacaaaccaccgtccgcttcagcgtttcgtgtcaatcaccgtaaacgcttcattgaacggccaccaccctatctagtcaagtcaagggtaaataaaaaccacagagccgaagtctgtggtttttgaatgactaaaaattagtcttcagatacaaaggctaataagcccatgatccgtgcacgcttgatggcgatagttaaagaacgttggttcttagcactagtccccgttacacgacgtggcaaaatcttcccacgttctgaaataaagcgacgtaataagtcagtatctttataatcgatgtattcgatatggtttgcggcgatgaagtcgactttacgacgacgacggccacctcttctttgttgtgccattgatatttccctcctcgttatctgtctaagcaattagactagaatggtaaaatcatcatccgagatatcaatttgatcgccattattagcgaatgggtcagcctgattattgttgttagcactgcttgatggtgccgcactgctagcattaccagtattaccattaccaaatgggttattgttattcgctgatgattgttgaggagccgcattttggccttgattactatacccattattattgttgttgtaattcgaattaccattgttgtaattgttattaccactaccaccattggcagactgatgacgttcagactctgcccgtgattctaataatgagaagttttcaacgacaacttctgtaacgtaaacacgtaccccttgttggttttcgtagttccgggtttgaatccggccatcgataccaacaagtgaacctttatgagtaaagttcgcaaaattttcagcagctttacgccaaatgacgcaactaatgaaatctgcttcacgttccccattttgattcgtgaattgacggtttactgggcaatgaagtgaacgtcgcgacggcggcaccaccattcgtgtaacgtaattccggatctcttgtcagtcggccaacaagaattgtacggttaatcatgcagaagcgctcctctcttaaaattaattttgtctattagtcttcgcgtttaacgatcatgtgacgtaaaatgtcatcattgatctttgaaagacggtcgaattcgtttaaagcagcatcgtcagttgctgttaagttaacgatatggtaagtaccttcgttaaagccaccgatttcgtatgcgaaacgacgctttgaccagtcttttgaatcaattacttgcgcaccgttatcagttaagattttgtcgaaacgatcaactaaagctgtcttggcagcatcgtcgatgtcgggacgtacgatgtaagtaatttcatatttctttgattcactcatgaaatttgcacctccttatggacttcaggcccttctttttgaagagcaaggaaagtaatctagctaaatgctagatactcacgaatttaaagtatagcatctaaatcagtttgttgcaagggttgaagcggccgactgttacaaaaagatcctgaatccgttacaccaatcaattacgtcaattgagcgatatttcattttatttcccgggaaatatttctttttctgaaattctccccttcgcttacattttcccacacccacacagcattaatttaaaccaagtcgacgtcagaataacacgcactgctgtaatcctctcaatcgcacaagccagttttgaccgcgtaaatctaaaattgcttacttcatgttgtcctctcccaatttatcggcatttctgccaatcaccggaagatgacaggactaagtgatgagcctccagcagtcaaattattcttcgcaggaagattctttctaccggttcaaaacaagactttggaggccagaataggaccgatgaccggtaaatcacacacgatccgttaccaaaataattcttgactcagcatgcataaaaaaacaagcgtggtcgacaagattgtcgaccacgcttgttttatcaatttattcgtttgaatcgtttgaatcagttgttggttctgtcgtagtggcatcggcgttgacggtttgatcgtcaactggtgcctcagtcgttgcatccgttgcgacagtctcatcaacttctggctctggatcaaccttggccatcgttgcgacttgaccatcatcgcctaaccgcatgagacgaacacctaaggttgcccgaccagtctgagaaacggttgcgatattgaagcgaatcatgaccccttggttcgtcattaccatgatatcttcttgaccatcaaccgtcgtcaaaccagctaaatgaccattcttctcagtcacgttagcggtcttgattcctttgccaccacgccccttaattgggtaatcggcagctggcgtttgtttcccataacccttttccgtgatgatgaagacgttgctgtcgggcttcaaaacgtcaaaagccaatcacaaagtcatcatcgcgtaagcgaatcccgcgaaccccagaagccgtccggcccatggaccgcaccgtggtttcgtcgaaactgacagcataaccatcgtgcgtcccgatgattatattttggtgaccatccgtgattgtaaccccgattaattcatcatcatccttaagcgtaatggccttcaaaccattgcttcggatattggcaaattcttgaactggtgtccgtttgacaacccctttaacggttgtaaagaacaggtagttatcagaagcgctcgcgtcgcccgtgacattaacgaccgcctgaattttttcaccagaattgactcccagtaaattgatgaccgggattcctttggccgtacgaccgtattcaggaatctcgtaagccttcatccggtaaactttacccgcattagtgaaaaagagtaggacatcatgggtcgacgtcgtcagtagatgttcaataaagtcatcatcatggacgttccatcccttgaatcccacgaccaccacggtgttgcgacttaaattcagtcgttggtaaccgtttgatgtagccattgtgagttaaggtaacagccacttcttcttcttcgatcaagtcttcatcttcaatactgaggacttcaccgaccatcaattcggtccgacgcttatcaccaaacttacgttgaatttccattaattcttcgtaaataatttggttgatacgatccttgctagctaagatttctttgtagtcagcaatggctttcaataagtcctggtattcactctcgatcttttcacgttccaaaccagttaaccggactaaccgcatatcaagaatggcttgtgcccgcttatcagacaagccgtaattatccatcaattggttcttcgcaatttcactcgtttgtgattgacgaataatcgcaatgatttcatcaatgtgatcaagggcaatccgtaagccttcaagaatatgggcccgtgcttgggctttttcttcaagtcaaactcagtccgacgccgaatcacgtcttcttggtgttccaggtaatagattaagatttgctttaagcttaagacttttggagcacccttaacgatggctaacatgttaaagccaaagttagtctgcatcaatgtcatcttgtaaaggttattcaagataaccgaggcgctggcatcccgccgaacatcaatgacgatccgcatcccttcacggtcactttcatcattgatatcagtgataccttcaatttccttgtctcgagctaaaccagcaatccgttcgatcaatttagctttattgaccatatatggtaattcggtcacgataattcgttgcttaccattcttttggtcttgaatatcgaccttcgcacgaacaataatgttcccacgaccagtctggtaagccttacgaataccggactttcccattacgatcccgccagttggaaaatctggtccaggtaagacttccatcaagtcagcaactccgttgcatcaggattatccatcaacaggtggattgctgaaatgacttccgctaagttatgtggcggaatgtttgttgtcatcccaacagcaatcccagtggcaccgttaacgagtaagttcgggaaacgtgctggtaagactgctggttcccgttctgtatcatcatagtttggttgccaatcaacggtatccttgttaatatcgcggagcatttcaaccgcaatcttactcatccgggcttcggtataccgcatcgcggcagcccgtcaccatcgacagaaccgaagttcccgtgaccatccactaacatgtagcgatagctaaagtcttgggccatccgcaccattgactcataaattgcggagtcaccatggggatgatacttccccataacatccccaacaatccgggccgacttcttatacggcttatccggcgtcacacctaattcactcataccgtaaagaatccgccggtgcactggctttaacccatcacacaaggtacgtccggcagtgcccgtgccacgataacactcatggcatagcttaagaatgacgttcgcatggtcttcgaaaggttcacatccgaaatacgattgttcgataaatctgaatcagccaaaatattcgtcctccttcatccgttttgccgctattaaagcttgattaagctttacatgtctcaagtaaaagtcgccattaagacaaccgtcgtgccattacgaccctaagtctgattaacagcttgcgcctcagttcttaggtcaaaatgactaaactgacacactaaacatccagatcctggacgaacttggcattatcttcaataaattctcgccgtggtttgacttggtccccatcaacatcgagaagaccccatcggcatccgcagcgtcttcatcacgaacccgtaataggcgccgcttgtctggatccatggtcgtttcccataattgttccgcgtccatttcaccaagccccttgtaccgttgaacaactggtttcggtgatggtgccaattgccccatgacctcactcaattcttcatctgaatcaatatacttcacaaatttaccttgccggacttggtacaacggtggttgagcgatgtacacaaagccagcgtcaactaatggccgcatgtaccggtaaaacaacgtcaataacaaggtccgaatatgtgccccatcgacatcggcatcagtcatgataattaatttgtgataattggctttgctcaagtcgaagtcaccaccgaagccagttcccattgccgtaaacaatgaccggatttcttcattggctaaaatcttatcaatgctggccttttcaacgttcaaaattttaccccgaatcggtaaaatcgcttgcgtcaaccgggaacgtccccgcttagccgacccaccggcagaatccccttcgacaatgaacaactcactaatttcagggtctttactactattgtccgccaacttacctggtaaattactaatttccaagccactctttttcgcgtaacttcccgcgcacgcttagcagcgacccgggccttggatgcaagtaaccctttgtcgaccactttacgggcaacacttgggttttccatcaagtacttgctaaagtgttctgagaataaccggtcaactgctgcccgagcatcggaattaccaagtttcgtcttcgtttgaccttcaaattgaggatccggatgcttgacgctgacaacagccgtcatcccttcacgaacatcttcgccagataggttcgcatcgctttccttcaacaagttattcttacgagcatagtcgttgatgacccgcgtcaaagcacgtttgaaaccttcttcatgcgtcccaccttcgtacgtatgaatattgttggtgaaggtcatcaaattactgtggtagtcgtcagtatattgcaacgcaacttctaccgtaatcccattctgttccccttccacataaatcggttctggaaatagaacggtcttattcttatctctagatattcaacatagtgacgaatcccaccttcgtagagaaagtcatcttcagtgggttcatcagggcgattatcccgaatcgtgatccgtaatcccttatttaagaaagcgagttcgcgaatccgagtcgtcaaaatattaatgtcataggtggtcgtttcccggaaaatatcaggatccggaacaaaatgaaccgccgtaccatgagcatcatcaggcgcatcaccaatgatcttcatcggtgttttaacctttccacgttcaaagtccatgtaataaacatgaccattccgagttactttgacgtccagggtcgatgataaggcgttaacaacggaagccccgaccccgtgaagaccaccagagactttataaccgccaccaccgaatttaccaccggcatgtaaaatcgtataaaccgtttcaagcgctggtttacccgtttttcttgaatatcaacaggaatcccacgaccgttatcagtaaccgtaatactactattatccttttcaacggtcacgtggatcacgtttgcaaaccccgctagggcttcatcaattccgttatcaacaatttcccaaactaagtggtggagtccttggctactcgtcgtaccgatatacattccgggacgtttccggacagcttctaaaccttccaaaacttgaatttgactagcatcatattcgcgagcctgttcaagtttggtttcttttcgttttcggtcaatgcggttcctcctcatgtaaagtgccatggctaacttcaaatacttttggcgcattaattaatttgcgggccaccccgtcaagacttggcgtggttaaaaaggtctgcactttatcttggatcgctgtcagcagatgagtctgccgtgcagcgtctaattctgataagacatcgtctaataataagaccgggtactcgcccgtctcagctttcatcagatcaatttcagcaagcttaacggacaaagcagttgtacgctgttggccttgggcgagccaaaaaagtctgcacatttttgccgttaacaccaaattgtaaatcatcgcgatgaggacctaataaagtcgtcccttgaaaaatttctttggcttgttgttgctgatataaggcctgtagcgtttgataaatgtgatcgaccgacgtctggtcagcagttggcacttgagtgacatagtgaaacgttaattgttcctgttcttgcgtaatctcgctgtgaacagcttgcgcccatttctcaagttgctgcaacagttgtagtcgtttatggatgatttccgcaccaaatgcagccaattgatccgacaagacacccaaataaaccttatccttggcctgctgccgatttaattgccgtaagtattgattacgttgttttaaaatcgtgcgatactgacttaggttatagaggtatttagggctcatctgaccaaattccatatccataaaccgacggcgaaccgcgggtgcccctttaacgatggataaatcttcaggtgcaaacactatcacgttcaaatttccgacgtactgggataatttggcttgctcaagatgattgactttcgctcgcttgccccgccgccccaattcaagttccaaggggacagcaccggtacttttatgtaaccggccttgcaacgttgccgtggtggtttgccaccgaattaattccttatcgttagcggtgcggtgactacgcgttaacgccaacacataaatggcttccaacaggttcgtctttccctgcgcattttcacctaatagaacattaacgccctgactaaaattaatggtcaaatccgcgtagttccgaaaatcatgcaagactaagttttctaagtacatctaatcagtcgtttcttgatttgagcgaataaaaaatgacccgttgtcttcaacttcaatcgtatcgcctggataaagtttccgaccccgccgatcatctggttcaccattaactaacacggttgtttcttttaagaaccacttcgcccctgaccacccgatccaatgatggccgtttcttttaagagttgccccaacgtcatatatggggttttaatatctattggctgtttcacaatgtcaccgcctatctgattacaagctattaaacgactgtctggcgtgctacacacactcctaacaggttatattatacttgtttttgatgaaaattcaatttataaccgcactcagagccattttaagacgatttagggctttttaatatcgggatactagcctaggggtaaatttgctgaaattccctaattttgcggattttaataaaatatcttgtttttacctataaaaattggctaaagccagcattcattatctgaaagcgagcgtttgtagcaacgagtgcaaggactggggttcatcagatggtgggattttagtagggcaacatcgatagttagcgtgataattcaccagcagctaatataatatgcataagttaaaacttcaaaagttacatcattgctgctattgcctattcattaccccatctttagctagttttagccgtcataaaaggcccgcatttcacggtgaaatgcgggccttttatttagaattgtatatttattcagctaattaaaacgttcgaactggtgtaatcaactgaataaagttttcgccttcttcagttggcactaaagtgaatggccgcaatgccatcgtgaatgagattttaatcatagcttgcccaaacgaacgtaacgcttctttcatgtagtctgggttaaacgaaatttcaagttcgtcacctgacaaatcagtgggctgtagttgttccgttacttccccgacatctggtgagttaccgaaaatcgtaatcgttttgtccgttgggttaacggagaagcgaaccacattattgcgactttcgtgtgataacagggatgcccgttcaattgctgctgaaagtacgggtgctgaaatttcaacagtcgtattagattctttaggaatcagccgtgacgtgtcgggataatttccttcgagtaagcgagaatagaaggacgtattccccagcacaaataggacttggttttctgataaccgcatctgcacgtcaggattattgtcgccgatcatccgagataattctgtcaaacttttaccaggaatgattacatcataattggcattattggcttctggcaacttgatccggcgttgacttaggcggtgtgaatcggttgcgaccgctaagaactcaccgttagctaagataaaatgaaccccggtcaggattggccgactttcctgattggaaacggcaataacggtctgaccaatcaactctttaagtacatcaccagctaacgtgatggtattagtcgtatcaatttcaggtaagtgtgggtagttttcagggtctaagccgttgattgtaaaggaagcggctcctgaagtaatttgtgtttgaaaaccgtcgaccacgttaacagtcatggtgtcttctggtaattttttacaccgatttcactaaagaaacgggcgggtaaaacgattgaaccggcatcttcaacgactaacgtattgttgtcatcacttgctggaatggtggtttcaatagaaatatcagcatcactaccagttaaggtaatagcgtcagtattaacgtcaagtttaagaccagtcaaaattggaatggtcgtttttgaagaaatggcccgttggacgttatttaattctttgatgaaggcagatcgattgatcgtgaatttcataagttaatcccctctttattctagcgacgggcactagatatatattaataataaaagttcgtagtaatagtagagcagtgggtactgtggaaaaccgagtaaagactcggcgttatcaagttttccacatgtgtataagttgtggaaaactttttgagttatcctttttatccacactaagatttgagctggcctgtcaaatcacccacggctttttgtaattcagcatcagttttgagtgccttagtgattttatcatgcgcatggatcacagtcgtatggtccttaccaccaaactcgttaccgatgcgcggaagtgaactttcagtcagttcgcgtgataaatacatggcaatttgacgtggaatcacgatttgtttattgcgtttctttcccttaaggtcagccattgttacatggaagtacttggcgactttttcctgaatgacgggaatcgaaacctctgatagtttactgctaaggtgcaaactcttcaatgcatccgccactaaactggtggtaatcggtgaattattcagtcgtgagtatgcccgcactcgtgctaaggcaccttcgagttctcgcacgtttgagtcgatctgaccggcgatataacttaacgtatcgtcagggatttcgatcccttcaagatcggctttattgcgcaaaatagcaatccgcgtctcgagatcaggtggggtaatatcaacggataatccccacttaaacctagaaactaggcgatctccttggagttgcggaatttcgttcggtaagcgatcggatgtaagcacgatttgcttatcatcttcatataaagcattaaatgtatggaagaactcttcttgggttgcttccttattggcaaaaaattgaatgtcgtcgactaataacaggtcaacgttccgatattcttcgcggaacgcctcctgtttttagtttgaatggcattaattaattcattcgtaaaagattcgctagtcacatatttaatgttactagtcggatcggtttctaacaatttgttaccgatagcgtgcattaggtgggtttttcccagaccaacgcccccgtagaaaaacaacggattatacatggtgccgggttcttccgacacaactaacgcagcggcatgggccatttgattgcctttaccgatcacgaaagtatcaaaagtgtatttcgggttgagtttcgtttcccgcataaatgtgggggtagttgcggttgttggttgttgtcccgcaacgttaccggtagtcacttgcgagtccttgtctctcgtaagttgctgacgttcttcttccgttatcatgaccggccgaatctgctcgttagtcgcttgcatcgcaatgtccgtgaactttgcggccaagtttttctcccaatagtcacgatgaagttgtgttgggacttcgatcgtcatttgggctttatcgagttggagtggttttgccggttcgacaaacgtttgaaacgtgatcttggacagatcttgttccatagagaacttaatgagattccataagtcattacgttccagcacgtggataccccttttcttaaaaaacgtaattctattttagcatgaacatatagagttttccacaagtggacaagttaaagttaagagaattcacaggctgggatttgaatatacacagcttgtcgaaaactaggaatgaattttataaaacagcacttatccacaaaaacgagtttaaaactaaagccgcaataaaagcgccgtttatcggagttatgcacacaacaaatacgccatgtggataactaaataacaacccgttaatttgtcgaaaaacttgtgggtaaattgcgaataacggaaagtcactttgctataatccacaaataaattcgcaattaaataatttttgacctcgaaattactacggagaaatttaatttactggttttcaaacaaataaaaatatgctatagtagtcaggaaatgcgtttagatgtaaactgcgttttgaaaataacgacttaatcgaattgattcatgtcattatggagaaggaggtgtcatgatgaagagaacttaccaaccaaagaagcgccatcgtcaacgtgtacatggtttccgcaaacggatgagcaccagcaatggccgtaaagtgttagcccgtcgacgccaacgaggcagaaaagtattgtctgcataggccactgataatcagtggctttttctttacagtcctagaccaggtgtttagggctgtatgtaaagttgtgtagcaattcgctcaagagcttgagcgcacacatggagatggattatgcgaaaatcatatcgggtaaaaaagaaactgagttccaacaagtttttgagacccgcaactcgtatgccaatcgtcaatttgtcatttacgttttggaaaaaccggggcaaccccatttccgcgtcggtatttcggtcggtaagaagatcgggaacgccgttgcgcgtaactgggtcaaacgccggattcggcaatcaatcaccgagctaaagccgcagcttaagcaagatgcagattttctcgtcattgcccgaccaaccgttgctggtaagtcgcaagccgaaaccaaagcttatctaagccatgcgctaaagctagcgcacccgctggacaatgattaaagtgaggacattcgtttgaaaaagtacagaaaaatactggcaatgctggccgtactagcgattgtactagttttgagtgggtgtagtaataccccaatcacggataagagcaccgggttttgggatggcttaatcatcttgaacttctcacgggcgattatttggttatcaaacttgtttggtcatagttatggtctcgggatcatcgtctttacgttgatcatccggatcattatcttgccattgatgatcttccaaacccgcaacatggtagccatgcaagaagtccaaccgcagatgaaggctttgcaaaagaagtattcgtcacgcgatatggaaactcagcaaaagctccaagcggaaatgaagaagttgtatgccaagcatggtgtgcatccaatggccagcatgttgccattactagttcagttgcctattttgattgcgttgtaccaagcaatctggcggacacaagccttgaagaccggttcgttcttatggttgcaattaggtagcaaggatccgtactacgttttgccaattctagcggcgatctttacgtttgctagttcctggttagcgatgaagtcgcagccagaacacaaaacgggatgacaacgtcaatgacgtatttgatgcctgtgattattttgattacggccattaacgtgccatcagcgttgtccttgtactgggtgatttccaacgcgttccaagttggtcaaaccttgttattacaaaacccattcaagattaatcgcgaacgggaagctaagaagcaagctgaacgtgatcgtaagcgaacgcttgaaaaagctagaaagcgcgcgattcgtaatcataaacgttaaatacaagtagacccgccatgtgtggtgggtctttttgttggttctgtatcatttttaccaatcggtcaatatgatttggactgtgatgatggcaggatgctaatgtgcgtttatgtaaggcccctggacggtccgtgatgaggaaattgtaatgaacgatcaggtgctggtaatcaagcggctgacaataatgcttgtcttgcaccgtttgatcacatgtttttaatattgtggcgcgtctctgaaacagtgccatgaacaggttggttattgacataataagcactagattttgctagtctgagttttcaggggtagtagaacggccgaagtcctaatcgttgtaagggttcattaagtgttcatactcaggtgttcgcatggcgaatggtaatgctataatgaaagcgggatttttaacgaggaggattcaagcatgacagtatttgaaggtaataccgtcgcggccgcaatcgcggctggtctaaaacaactgcaccgaacacgcgatcaagttgaagttgaagtgatcgctgaagcaaaaaaaggatttctggggctaggcaaacactccgcccaagtacggctaacggtggtgccagcctccgcagcacccgcaacgacgccaacttccgctacggcgacagcgcaacagtcagtagctactgaatcaacgacagcaccgaccatgccgcggcctaccgtgcggacaccaaagtcaacgccgaccagacaagctaaaactaaagtcaggccacgaccagtgccgcaaaaccagcgactagcaaggcgaaagcagtggctaaacccgcttcaatggcggttaccaccggcccggttatcgctgataccgaccaatctaaaccagcgaccactagtaagaccaaatcagtggctgctgaccagagccagacgccgcggacacccgcagaaatagcagcgcgccaagcggctaacgagaccgcggtgcgggcgttgtgtgattacttgcttgcggtggtcaaagaactaggtgtcacggcggatcttgacgtcgacttcggcaaccgctatgcgacattgaatttcgatacaactaagcggggtttgttgattggcaaacacggtcgaacgatcaatgcactgcaagatttggcgcaagtttatatgaatcatcatggcgcgtcacacgttaacgtggtgctagatgtggatgattatcgggagcgccgggctgcgacacttaagcggttagccgagagtacggtctcgagaagtgattgcaacgggcaaacaagttttcttggacccgatgccatcgtttgaacggaaattaattcacgctgaactagcgaataatcaccatgtaaccacattctcagaaggccgcgatccgcaccgggccgtggttgtggcgattcgcaaatagtttattcaaagtaacgcaaacaggcgtttgacaaactccgggtgagctattatagtaggtgttaatcattcttatcttttagataaagtagtcaaagtgctttatccacgctttaaggtggcgtggactaggcgcttttttttctgcattttaggacatattattaactaattgtaagtaaatttggtatggtattaggcgatgaaacgctgacaagaaaggacatgatggtatgccaacgaccacagaatttgacacgatcgcggcaatttcaacgccgcctggtgagggtggtatttcaattattcggattagtggggaccaaacgtttaacgtgggttgacccagatttttaagggtaaagatctcagtcgagtgcaatcacacacaatcaactatggacatattgttgatcctgatacccatcaggaagtcgacgaagtcatggcgaccgtaatgcgcgcgcctaaaacttatacgcgtgaagacgtagttgaaatcaactgtcacgggggactcgtggcaactaatgaaattttacaattgatcttgagtcacggtgcgcgaatggcggaacccggtgaatttaccaagcgggcattcttgaatggtcggctggacttgtcacaggcggaagcagttatggatctgattcgtgctaagacggataagtccatgaaggtcgcgttaaaccaattagatggtgatctatctaagctgattcgacatttacggcaagatattttggacgtattagcccaagtagaggtcaatattgattatccagagtatgacgcggttgaaacaatgaccaccaagatgctgaaggagaaggctacccgaggtcgcccaaagcattaatcaactgttagcgacggctaagcaaggtaaggtcttacgcgaaggtttggcaacggcgatcattgggcgtcccaatgtcggtaaatctagtctgcttaaccaccttttgcatgaagacaaagctattgtgacggatgttgccgggacgacccgcgatgtgattgaagaatacgtcaatgttcgtggagtgccattgaaactcgtcgatacggcgggaattcgggacactgaagataaggtcgaaaagattggggtcgagcgaagtcgcaaagcaatcggggccgccgatttagtcttattagtgttggataatagccaaccgttgacggctgaagaccgagagttgttgcaagagactgaccagtcaaaacgaatcgttatcttgaacaagactgatctaccagcccgtcttgatcaagctgaattggcgcaattagtcgatttgagtgacgttttaagcatgtcagtcttggaacaaagtggcgtcacgcaacttgaacaacggattgccaagatgttcttcaatgaaggtatcgaaagtagtcaaaataacgtgatggtgaccaatgcgcgtcacatcggtttgttgaatcaagccaaacaagcgttgcaagatgttcaaacgggacttgcggctggtatgccagttgatttggttcaaatcgatatgacccgttgctgggaattcctcggtcaaattaccggggatagctatgaagatgaattattagaccagctatttagtcagttctgtctgggtaagtagtggtaggaggaaattggaatgacagaagtaaagcagtacccaggccgcgactatgatgttatcgtcgttggtgctggtcatgccggttctgaagcagcattggccgctgcccgaatgggtaaccggacactcttaatgacgatcaacctagacatggtggcctttatgccatgtaatccatcggttggtggtccggctaaaggaattgtcgtacccgtgagattgatgctttgggcggtgaaatgggccgtaacattgataagacttacgttcagatgcggatgcttaatacgggtaaaggcccagctgttcgagctttacgggcccaagctgataagcatgcttaccatgcggaaatgaaacacacgattgaacgggaaccgaatctgacgttacggcaaggaattgtcgatggcttaattgttgaagatggggtctgcaagggcgttatcacgaatacgggagcgcgctatagtgccaagagtgtcgttttgacgactgggacggcggctcgtggcaagattatcattggtgaactaatgtattcttcgggtccaaataattcgcaaccagcgatgaagttatctggtgatctggaacgacttggatttaacttggaacggtttaagaccggtacaccaccacgagtcgatggtaatacgatcgactacagtgttacggaagaacaacctggtgatcctgaaccacatcatttttagttttgaaacgaaggatgctgactacattgatctaaagcatcaattatcttgctggttaacttatacgaatgagacgactcataagatcattcgtgaaaatcttgatcgagcaccaatgtttacaggcgtgattgaaggggtcggaccacggtactgcccatcgatcgaagataagatcgtgcgattcgctgataagaagcggcaccaattattcttggaaccagaaggccgtaatacggatgaatggtatgttcagggcctttcaacgtcgatgccggaagaagttcaacagcggattttacattccattaagggtcttgaagacgctgaaatgatgcgcccaggttatgccatcgaatacgacgtggtggcgccttaccagttaaaggcaaccttggaaacaaagttggtcaagaatctctatactgctggtcaaacgaatgggacttctgggtatgaagaagccgctgggcaaggattaattgccggtatcaacgctggtttgcgagcccttgatcgtggtcaattcactttgaagcgtagtgatgcttatattggagtcatgattgatgacttagttactaagggcaccaatgaaccctatcggttactaacgagtcgggctgaataccggttgatcttacggcatgataatgctgatttgcggttaacggataagggctgcgagttaggattgattgatgatgaacggtatgcggcatttgaggcgaaacgccaagcaatcaagaatgaacttgaccgtttaggcaaaatcagaatcaagcctaatgatgaggtcaatgctttcttacgtgctcataactctggtgagcttaaggatggtgtgttggcggcagatttcttaaagcggccagaagtacaatatgctgatttaatgaaatttatcccggcagcacccgaaccactagaacggcatattattgagcaagttgaaattcagatcaagtatgccggttatatcaaaaagcagaggaacgtgttgatcgattgaaaaagatggaagctaaaaagattccggatcggatcgattatgatgcgatcgacggattagcgactgaggctcatcagaagctaaagaagattcagccgacaacgattgcacaagcttcacggatcagtggggttaatcccgcggatattgcaattctgagtgtttatattcaacaggggcgaatcgctaaagttcaataatcatcagtagtaggttatgactggtgtgttcagttgatattaacgaatgatgaaagaaaaaaattaatatttttaacgataaagcacaattccaacttggaattgtgctttttagtgagcttacttttaattagtacacgtttcattaaaaaaacaacaacactttaattaatgatgactaaattaaattaaggtattatacttcagaactagtaaacattgtttacagtgtttacaaaataaaggggagttattgttggtaagagttagtaagttagtcagtggtattttagtggcaagtagtttattagtgagttcgggtgtcatcgctcaggcagatacgcccgctgctcccaacgcagatagtacggccaatacgactggtacgactgatattcaggcgatgtttaaaggtaatagtagtccggtatcaccagttaatccggataatcccaataagcctgataatagcggtgatagtggtaacggtgctaaagccggtggcggcttatcgctgatctacgtttctaataaattagattttggaagccatgagatcgatgttttaaatccagaaacgtacactgccgcagaaactgattcggatttatcaggtttatggaacaaaaaagcagtcacagaagtatctgatgtccgaggaagtaatgctggttggacactggccgttgccgggagtagtttgactggtacagacggttctgtaatgaaaggggcaacgcttcagctaccaaaaggtacggtaactaattctggttgcaactaataatggcgtgcagtccactgaggctcttaacgtgttagatggtaattcggcgacagtattatcggcagcgaaagatcatggtgctggtgtaactgttgatcaaattgatccaagtaatgttaagttaacggtgccggcaaacacggctaaagcgcaggggtaccaaacaactttgaactggagtttgagtgatacaccagcaagttagttagaatataaccaagaggggaagctaaagcagatggcgatggctaacggttattatggataaagtaatcgttgatgtaatcgcgagcagtggcttcccttttattaaatgatagctttaaaagatgcgtcataatatggggtgtgttgagattgaaagtggttatccaattcataagactaatgggtgtgagtcttggatttagtattttaatcggacagacaggagtgtcggctaatcggcaacaatcggtccacaacaacaatgtcggttttagtgttgccgccgctgagataccaaaaatcagattcataaacaaaattcttttttgatttgaaaatggcaagcggtcaacagcagacgttacggacagtcatttacaatgtcactaataaggatattaaggttcgaacggctattcataccgcgtatacgaatactaatgggacgattgaatatattaatccggccaaatcgtacgatcagtcgttaaaataccgagtcagtgatttagccacaattcagggtgagcggacaataacgattccggctgaaggctccaaaacggtcgcaatcaaggtgaagttacctaagcagccagtaaatggcgtcttgttgggtggatggtattttaaacgggttgatgacaaggtaacaggagtaacggagaaaagtatcaacgttaagaatgagtattcgtatgttattgggttgaaattatcttcaggaaaattgccaattcctaatttgtgtctagggccggtgaaagctggcttgaacaattatctccatcgatcgaagcattattgttgcgctacgtaatcctgtcgcaagaatcattccgaatttaaaaatccgaacggtgattattaataagcggcatcaaaaggtcattattaagaatacgaaaacgggtgtcatgatggcgccaaacacagtttttaaagcaccaatgccattaggatcacaacaattacaaccgggtgattatcagttacaaatgacggttaataatcagcgtcatcattggcgatttaaacgagattttcatattagtatgacagcagctcaaaaatataatcatgagtcaattgataataaggggttagtatgtggatgctaattggaattggcgcaatttcaatgctagtactggggttagggttaggcgtaatcgtctggctatggcggcgacaacggcggtcgaaggattaggttaattaatgggggtaggatggtgcaacggtttagcgtgtgtgtagcaaccattttaatcagtttaataatgttaacaaataacgggagttgcggccgttgggggcggtcaacagtcaccgttagcttttatgctggtcagagaactcagcaacagatagataatcgcaacgttaagattcctaatgggaccaggccatatcgtgtggtgacagaaaagacgttgacaagaccaaaggggtattatcaattgccacagactgatgagcagctcttaacctggttttatgcgagtttcggtagcgtgctactgatattattgatggttatccgttggtttaataaagaaagctattgctaggtaaggagggaccgtagaagtgagaaggttacttactggcacgttggtcgtgggtgggctgttattggtagtttgcctcatggctgttgggcgaggcaaaggttgtcgatgagccgaccagtgcgatgcaggatattacaactaatttcgaacaacgaacaattggtcgagtgccatggcccattacacacattgcggctaattatgtgcgcaagatggtcacatgacgcacaagactagtcgagtgaaaattactttagggaaaggtgtagtacattcgccgaatggtaagggattatataatttatgggatctggttttgaatcgccaaggcaaagagtatggtgcaactttcctggcttataatatcaataatcgagtttggcgaccgcatcgaacagatactatcaagacgcatggaatcaaagcaggtcagccggtttggattggtaataagagcagtactaatgcgagcagtaatcccattcgaacactgcccgcttacatggtaacgaagcagtactgtcaaatggttagtcagattaaattatcaccacatattactggatttgaggctaataagcgcatcattaccgggacgggcacacaaggtggtgatctaatcacggctaaatttggtaatcagatcaaaaaaacacgagtcgatcatgaggggcgctggcagatgaaatgctttagcggtaatggtcaccttgatggtaacggaaacaaatgcgtatgatgatattccagggcacactgaaacggtgattaataacggaactccacgaacggatgcgacgattaagctcaacttgtttttaactaatggtcataccttttcaaccgctaagggacgcaaggtattagtgaccggaatgatcttggggactgatcagaatgattttgatcgcgatgttgttttaaaaataacgcactaaccatccactttgcccatgctgatggaacgcccatcgctaattataaggctaatggttcggtgaatgagccagataaggcggggtattttcatctgaaattacccactgaatcgcttaaacaagggcctaatgatgtgaaagtgtgggtgtcagatcaacacggccaacgatctaatattgatacgttaacagttaatgtaaattcaggactcatgtttggtcaaatcaatgctcaaatgcgttttcggagtaacacgattccacaaagcgacggcgcttattatcgcccacaaatcagtggcaaattgaggttcatgatacgcgatcagttgcttcaaagtggtatgtgtatgccaccgcaactaaaatgaagtctgctcaacactcattaattggggatttggtctatattgatgctgctggtcaaaaacatgtgatgaccaatcaggaaacgttggtaggccatggcacacatacaaatcctaatcaacaaactacaaatattgcagcaacctggcaagcgcgacaaggtatttttctcgatgttcagcccgaattgtatgcgggatcctatcatggaaagatcaattgagtttgcaagatacaccacaatcttgatgagtggaagaaagatgtcatcaagatgtgttagttagtcattaaggaaattatgaatgaccgtcaagattgttttggcggtcattttagtgtgatatcgttgcaaggttacttataaatttgtaaaaacgattcaccaataccagacaagctgctggagttgattggactataatgattggaagttatagcggggtaagggagaacgtttgatgaaaacttttaagagtattatgagctgggtactaccaattgtagtggggttactcgtcgccatggtgatcaggcactttatttttacgatggttcgggtggatggaccgtcaatggaacctaacttagatgacaatgagcgcgtcgccgtggtcaagacagctaagattcagcacctcagtgtcatcgtttttaacgcctatcaagttgatccagacgcacgctccaagacggtcaaatatgtcaaacgagtgatcggaatgcccggtgatacagttaaatctgaagacggccgactctatgtcaatggcaagcttgtcccgcagaagttcatcagtcagtatgagcggacgcgggaacgacaaattgggatttgagtacgctggagaaccgttacagttggaatctgaaaacaactaaggtccctaagcattcgtactttgtgttaggtgatcatcggtcagtgtcaaatgatagtcgttactggggatttgtcccagccaataaggtattgggcgtggtcaaagtgccattttgggactcgaataaaactaagcgccataatattaattcaattagttactgaatagcagccagcgcgactcgttagtgagcgcttttttttgtatgctcaccaactgaatggtagggggaactaagttggttagtcattctttacagggagaacaacgtgggatggttaaagtgactaatgttgttcagaaaagcaaacaaaaggtagcatctaaattgaatttaatggtcaataagcctagaataatggcaagtatcacgatggaggctggtaaatatggcaactgaactaacaccggatgcacttgccgctttacggacaacgcatgcgcaggatcgaatggcaccagtattgacgcgagcgattacgaagaatgggattgaggctgcaagttttgataatcatcaaagctgcgagtcgcttagcacggactttttctgttgaagtaccaacgggtaaggtcagtaatcagaagcacagcggtcgttgctgggagttttcattattaaacacgctccggcataagtttgcgacccggtatcacgtcaaagactttgagttatcacaaaactatttgtttttctgggataagattgaaagggctaatatttttatcggaatgttgaacaaacggcgcgtcagccgattgatgaccggcttgttcagttcttatttgctaatccgggcgaagatggtggtcagtgggcgatggcggccagcttggttcaaaagtatggcgtcgttccagctagtgtgatgccagagtccttcaacactgataatacgacggcatttcaagccagtttatcacggcagcttcgtaaagatgggttaaaacttcggcaactcgtgatggatggtgcaagcgaggccgagctacaatcactggagaaatcaatgttgcaaacgggtctatcggatgacggcgtactcatttggtgaaccaccaactagctttgatttagaatatcgtgatgatgagcaacagtaccatcgtacggctaatttaacgcctcagcaattctatcaggactactttgaaactgatctggatgattacgtggtcgttactaattcaccagataagccgtttaatcgactttatagcttgccagacgaggataacgtgattggtggtaagcctatcgaatttttgaaccttgatatgggtgtgctgacggacgttgctgtgcaacagttacaggctggcgaaacggtttggtttggcaacgatgtgttgcgacagatggaccggaagacgggatacttggatgctcatttatttgaaactggcaagttatttggaaccaacgatcatctgactaaggcgcaacggctgttaacaggtgaaggtgaagttagccatgccatgacgttaaccggcgttgacttagtggctgatacgccaagctaagtggaaggtcgaaaatagttggggtgagcaagtaggtgatcaaggctacttcgtaatgagccaagattggtttaatgagtacgtctatgaagtagttgttcacaagcatttcttggcaccggaatttcaggcgctgcttaacgaacgtgcacagcggctacccgcatgggatccgttgcactaggagggtaatgtgatgggaatattttcagaacgattaaaagaagcgatgcaacaagcgaacataacctctgctcagttatctaaacaaacgggaattggtcgttcatcaatcagccagtggttaagtaataaatacgtggctaaacatgataaggttacggcgttagcgacggtactgaatgtgtcgccagattggctgctaggtacgactgatgttgcaacagcggtggccccggaagcggtaccgattccagtatcggtcacgccaacccccgccgttgaccccgaattaataacattgtgggaacagctggataccaaacaacgatctaagttgatcaaaaaggcacggaagttgttgactaagtcggccgaacagcccaacacaaagcggaaaaagaacaagaaaaagaaaaaaaggcaagaaacggaaataaggcaatgcaaaaacaacttttgctcctcagctcgtcgtgaggaacaaaagttgtttttgactgtcatgatgaatgattaggggttgataatggtgaactaaatggtccatttttcccagtcacgcgcccaaatcagtcccatgacgccttctccaacgtgaaccccaacgacgggaccgatctcgccttcatcgatggtgagatcaggaaagctagccttcaagtcagctgtccattcggcttggagtttcggattgttgccgttttcgattgtgacgcgaagtggatagtcaacggcagcaatctcggcagccagcttggctttgatggctgcgtatgcccgccgcatcgttcgttctttttgaatagcgacgatcttgccatcttgaaaggtcagaacgggtttaatgcgtaagaggttgccaacgagtccagaagcgtttgagagccgaccagtccgaaccaagtgactgagattatcgacaacaaaatatacgccggttgtttcacggatttttttgagctgagcaataacttgttcgggtgagtatccttcagcgactaatttagcagctaacaagaccatgtaagcttctccaccagccgtaattagtgaatcaaacggataaaccttgatgttggttacgtttggcgggtaactttcgagattagtaataaagctggtgataccagaagaaagatggatactaatgacagcatcatagcccgcctttgccagctgatcataagtcgtttgcatctgaccaagggtaatctgagtggtcgttggtaactcaggcgcggtacgcattcgttcataaaattctttggacgttatttcgacgttttctaagtaggtttggtgaccaaaaaataacagtaattgggacgacgtgaatatgatacttttcaacatcggccgctgagaggtagcttgcgctatccgttacaattgcggttttcatttttcccccgctttcatttggtgaaagtattgcctaacattataacgcttgtcagtagttgaaagctagctttgatgaatagattaaggcgattaatgtttgaaattctcaacaactaacgtcataatgagaatcattaaatggggagggcacaggatgaccaaacgaattgagataaaaccggcaacagctgcggatcaagcagcgctggctgaaatatatttagtggaccgtcagcaagattttccatgggtcactgatccacaactgcaagattttaacgaagacagccgtggtgaattcgtgctggtcgcgtggattgatggtcagcgggctggcttttgttcgttgtaccggctggccaacttcattcatctgctttttgtggccccagatttccgccacttgaaagttggtgaacggctactgacagaaatgcgccagtatgcaaccgaaccactcacgttgaagtgtgtgatggccaacgaaaatgccccgcgattttatgcgcaagtagggtttcgaattgtcaaagcagatgcggacgcgctcccaccaaattatacgttgcgtgatacgcatactgagcagtacgtggcattagtggatgttatggccaatgaacgcaaacttaattaatctaatttatttttaattttaaggttgacattgtgataatctggcgctagaatctaatcattaattaaatttagattaaaaaccgtgataaggaacggtgctaagctggttagttagcgagctgcggattggtgtaaggcagtcaataccacttaacatagatcaccttggagttgcgcctcgaaattcgtggagatggtgctggatggtacccattaatgtaccggcgtatcgcaattgctgtacgtactaaggtgactattgtgtgaaagtagtcgcgaataaaggtggtaacccgttctggacgtcctttaattaactcataggagttagttaaaggacgtttttttatgatttaaaggtggtgaggagtatggaatcggacattcaggtggctagttaccaacaaatgtgggcaatggtaactagtcgcacgaggacttgctcctcgagtaacacataggtcaacaaggaatcaaaaacacatagtataactgagtactccgggtagatcacatacgataccacgtgtatcgattaacacatagttttagcaacgtgcaatttatacgtttaggcacacatagttttaacatgaacgatatttatgacccgtagtcttaataattcgtatttaagacgcccttacaattagctggcgcactgaatacatccaaataatgaagtgacaactagattaattgtaatgagttaacgtattagcaatgattagacggcctcattacgaacacatattgggataacagtaaccaccacaaacacataatggaggttttataatgacaactaccaccacagaaactcaagttgcacaacagctatttacggcctatcagacacagcatgcgttaacaatggctgattttacaagtagtgtcgctgacgaagacgctgcgtatcgagttcaagccgcattaacggccttaaaacagcagccggttggtggatacaaggtctcgttgacgagtgcggaaactcaaaagatgtttgatgctcatgcgccgctgtacggtgcccaggttgcagatcactttttggcggcaccaaccacggttcgacgcgggcaactaatggacccactcgtcgaagttgagttggtctttaaggctaaagaagacctgtcaaccaccgattcattgaccgatttatggcaaaaaacgactgtcgcgccgggacttgaattgccagattcacgttttgctgactggtttcccgatttgcctaaaaatttggtggtcgcggatgccgcagtcggtgggctggtggtatatggaactgaacgggagactgccgagttgttcgcttcagctgatgcagtggcaacgccaaagtgtacgctagtccatgatggggagacggttaaaactggtcaagcgagtgaagtgttgggtaacccgcttgagtcattgaagtggttagtcggcaagcttgcagagcaaggtaagacattaacggctggtcaacgagtttcgtcggggacgtttgtcctaccaccacatttgaccgcggggcactggcaagccgacttcgatgccgggctgggacaggtcgcactggatgtaacggaagcctaagtaaaataattacgaaaaaggaggctgtgacataagtctctagaaacaaagcgaggtctggaaaaatcttcggatttttccagacccgcttttgatataatagaaaataaaaaaaaaagcatcggtcgcacccgatactctacgaaattatcctcgaaaggacattcctaatatgcaatggattattataacatgaatcaaaccactttgagtattgccttggattaccaaccagaagagcatcattctgctcgttacatcaaccagcttgttgagagtttaaaactaaaatatgattaccagtttggccgtccgcgggaatataacctcggtgccatgttaaaactggtccttttagcgtacagctatggcattttcagcagtcgtaaaattgaacggtttgcccgtgaaaacaagccagctgggtggttaattgccgaccaaattccgtcctaccggacgatttgtcgctttagaatttctgatgaactggccactttgacaaccgatagcttatcacaactaactcaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgacctgttagcgcgagcttcatgaagctaaaattgtcggtgaaattccggcgggatcagagctgactcccgaactattggatatcatgattagcaaggttgaggatcacttagtggtccttaatgaaaccgtggaagcaactaagcgggtttccccgaacccagccaaacagcaacgccggactgttaaatcacaaaaacgtaagttggataaacgacgtgataaaatgcgtgaacaccaagcacagcaagctatttatgatcaacgtaacagctactctaagacggatcacgatgccacctttatgcgggtcaaggaagatccgatgcaaaacggtcaattaaaaccgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaaaagtaattatcggtacttggaagatgaattcggtcagcataccgttttgattccctacggcacaatgtttaaagagaatagtcgaaaatggcaaagtgatgaccgtaaggttatgaactgggactatcatgaaaaagatgattattttatcaatccacaaaacgtccggtttaattttaatgcttatcgtcaacggactgataagtatggttttacccgtgactttaaagaatacattgccgaaaagtatgatgaaaatcatcaactaatttccgcggcactaacaccaaaaggatatcttaaaaggatttccgtgaacgaaaattgggaatatttcaaatcgaaacaacgagaattactttcagctccagaaactggtcagatctacgctcaacgtaagatcgatgttgaaccagtttttggcaagatgaaggcttctttacatttcaatcgattctcggtgcgaggtttcgacaaggtcaccaaggaagccggaaactcgtaatactggcgttaaacattatgaaactggtcacggtagggaccaactttaaaaatcaaaggcgtaagcaaatgggacgagaaaccaaaattcggtttctcgtcccatttgcttatacagaggctagttatgtcacagcctcctttttgaagtgttgctaaatgaatgtttttcagatgattagtaattttcaaagattggacagactgctaattatccaatttgtagaccagaatgtttcacgtgaaacattacttatttaaacgatggtagttttgatcaaagtacttgccgttgcgaatatcattcggcatttctttgtaaggtgcttcactgattacatcttcattgttttggccggcgtcgcccatgtaagtaatattggcaaattcgggtacaactagttttggataagtggcatacttttcacgagactgttccattaaatcgatgtgttcgttttggtaagtgaccgtaatttcagggtgttcttcaacccactttgggaagaaaatcgtaccgtgtagtttcttctcattgggcatgaagtctagtgcaacgtcagtcccagttggttcagtccaagaaattttgtaaatgccttcggtcaacatgacgatgtcagctttttgatcagtgacccaacgaccggcaaccatcccaccgtggattcggtaatcaacggtgtggtcgttcttggcgtaccactcgtattcccagccgttatcataagtgtagataaagtgtgtgccgagaaagtcatcaagtgttttaaaagtttttgtcattagaattaccttccttatgtctaatatgtcattttaatcatgtaatttattacatgttttaaacaacaaggttagtgtatactgttatcaaggaatcgtcaaggaggaatttccaatggcgcaaaaaaacaagttacaatttattattctagggttattaaaccagcaaccattaacgggctatgatctaactaaagcctttgatgacgagatcggtgaattctggcaagctcaacatagtcaaatttatccgcaattgaagcgactagaagaacaaggttacgtcacgcatgaaattacggtcagtggcgaaaaacttgaaaagaaactctaccacatcaccgcaactggtcggcagctgttacatgagtggatcagtgtcggtacaccagacttaaccgctacgaaagatgaatttattttaaaactatactttattcaaacggatcgtgatccacgcctactagcgatgttacaggaacagctcaccttgcacacagctaagttagcacacttacaacagcgattggcgaccgttttcccgcaagctaaagctgctaagcaacattatggtcactatttgatcttacaacatgcgatcggacgagaagactactatgtgaattggttgaagcagacgttgaaagccttaccggagtaatggggagagtgctgccgctctaactggtggctggaatcatagcgttaaaagctacccttaattatttagagcggcgtttgaaggaaatcagcttatgattatatgcgtgtgagaaatggtgccgtttgaattctgaaactggtataatggcagtggtcaatatcaattcacttcaatgaggagattaactatggaaaatcaaaaatgcaagagccacttgtctatcggcgaattttactgaccgttgatgaggacgataatacctcttcagaacgtgcgtttcgatacgcaacgactttggcccacgactatgatgttccgttaggaatttgttcggtgctggaaagcgaagatatcaatatctttgattcattaacaccgtcgaaaatccaagctaaacggaaacacgttgaagatgtcgttgccgagtatgttcagcttgctgaacaacgaggcgttaatcaagtagagccgtttgtctatgaaggcggtgatgtggatgacgtcattttagagcaagttattccagaatttaaaccaagatctattagtgaccggtgccgataccgaatttccacattctaagattgctggggcaattggtccgcgtttagcccgaaaagcacctatttcagttatcgttgttcggtaatcaagactcgggacagggattaagatccaagctgatgaaattttaacaaccgcaagctcatcatggctaatgaggagcttgcggttgtttttgactgctattgttcattaatgaacttaacaatttaatttttttattggctataaatactgctaaacatgagtttataagtgtactgtttggatgatattaaataatttttcaaattcttgttgcattatgagcaaggatggctataataaagtttgtaaattaattcacaaaggaattgaacggaggaagcacttcatgattaagacagaaaaaaatcaaacaagcaaagttactgatgaagttgatcaattagttcaacgttctaagaaagcattagctattttgaagtcatataataacccaagcacaaatcgatgatttatgtgaaaaggttgcggttgccgcactggacaatcatatgaagttagccaagttggcggttgaggaaaccggtcggggtgttgttgaagataaggcgattaagaacatctacgccagcgaatatatctggaacagcatgcgccatgataagacagtcggcgtcattaaagaagacgatgaagagcaactaatggaaattgctgaaccagttggtatcgtagccggggttacacccgtaacgaatccaacttcaacaacggttttcaagacgttgatctcattaaaggggcgtaacacgatcgtctttggtttccatcctcaagctcagaaatgtagttctgcggctgctgatgtgatgcgggaagcgattaaagctgctggtggtccagctgatgctgttttatacatcgaacacccaagcattgaagcaaccgacgccttgatgcaccatacggatgttgcgacgatcttggctacccggtggtccaagtatggtgacagccgcttactcatcaggtaaaccagcactgggtgttggtcctggtaacggcccaacttatgttgaaaaaacagctgacattaagcgggcggttaacgacattgttttatcgaagacgtttgataatgggatgatttgtgcttctgaaaatagtgccattatcgacaaggaaatttatgctgaagttaaagctgaatttattcgtttgggttgctactacgttaaacctaaagatgtgcaagccttgagtgatgctgtcattgatcctaaccggcacacagttcgtggtccagttgctggtaaaacagcttatcaaatcgcacaaatggctggcttgaaagatgtcgctaaggactgccgggtcttgattgcggagattaatggtgtcggtatcaagtacccattatccggcgaaaaattatcaccagttctgaccgtttacaaagcggattcgcatgaagcggcgttcaaacgggctaatgaattacttcactatggtggcttaggccatactgctgggattcatacgaccgatgatgcattggtcaaagaatttggcttacaaatgccagcttgccggatcttagttaacacgccatcttcagttggtgggttaggtaacatctacaataacatggcgccttcattaactctgggcacgggatcatatggtggcaactcgatttctcataacgttacagatatggatctgattaatatcaaaactgtggcaaaacggcgtaataacatgcaatgggtcaaaatgcctcccaaagtctacttcgaacgcaattccgttcgctacttggaacacatggccgggattaagaaggttttcctagtttgtgatcctgggatggttgaatttggctatgctgatcgagtaacggcggtcttgaacaagcggactgatccggttgatatcgacatcttctcagaagttgaaccgaacccgtcgactgacacagtctacaaaggaggggttgcccggatgaaggcctttaagccagatacaatcattgcactcggtggtggttctgcaatggacgccgctaaggggatgtggctcttctatgaacacccagaagcttccttcttaggtgctaaacagaagttcctggatatccggaagcggacgtacaaagtaccagtatccgaaaaagtaacttatattgggattccaacgacttctgggactggttctgaagtaacgccatacgcggttattacggactccaagacgcacgtcaaatacccgattacggactacgcaatgcaaccagatattgcgatcgttgacccacaatttgttgaaacggtgccaaagcggacgacggcttggactggtctcgacgtaattacccacgcaaccgaagcatatgtttcaacgatggcttctgacttcacacgcggctggtcaattcaagctttgcaattagccttcaagtacttgaaagcttcttatgatggtgacaagatggctcgtgagaagatgcacaatgcctcaacgctagctgggatggcctttgccaatgccttcttgggtatcaaccactcgatcgcccataaattaggcggggaattcaacttaccacacggattggcaattgcgatcacttatccgcaagtcgttcgttacaatgctgaaatcccaacgaagttagcaatgtggccgaagtacaaccataatactgccttagccgactatgccaacattgcccgggccttagggttaccaggcaagaccgacgaagaactcaaagaaagcttagttaaagcttacattgacttggctcattcaatggatgtgaccttatccttgaaagccaaccgggtcgaaaagaagcactttgacgccaccgtcgacgaattagccgaactggcctatgaagaccaatgcacgaccgctaacccacgcgaacctttaatcagtgaattaaaggcgattattgaacgtgaatgggacggccaagccaaggtactgaaaaatagccctttgtgaattaaggagcccgcgctcatgatgagcgcgggcttttttgtcatgtggttttagaataactacctggaaagtttttactgtttgttttcagaggaggagaaaatgaagacttgatatggataaattatcggcttgcacactatatagatatacttataggtgtactaaatatttttgagattcggttaggaaaattcggcgttctaggctacaataatgcaagagttaattttacggaggagaagcccatgaaaaataaggcagtcacaatcaaagatgttgcgcgccttgcagaacgctcaattgcgaccgtgtcacaaattttaaacgggcatggtgataagtttagtgcggcgacggttgctaaggtggaagcggcccgggatgaattaaattatgagcctgattactttgctcagcggatgattaagaagaccagcaaaacaattggggtccttgtgcctgatattcggaatcccctttttggtgagctgcttcgaggcattgaaaacgtcttgtatcagcaaaatttcatcacgatgttgtgtaatgctgatctggatgaagacaaagaacgcgtctatttggatgaactcagccgccggggtgtggatggctttattatcgcaagttcggccgtttccaataatgcgattaatgatattctacggcagaagggtcacccatttatcgtcttagaccaaaagcgcgccgaagggttcagcgattctgtgttgactgatgactatgatgggggcggcaagctgctcaacacttaaaagatttgggacaccggcaagtcgccgttcttattccagcaaaaccgtcagccaatgtccaaaagcggcttagtggtttttatagtgtgtatccgcggacagcggtacatgtcatcgcgacgccgctttctaaagtgggtggtcgccaagttgttccggaaattttggcgactggagttacggggatctttgcagtccaatgacgaaatcgcattcggtgtatacttaggcatggctgaacatgataagcggataccggatgattacagtgtcattggctatgacgatgtcgaaatgtgccaatatgtcgcgccacagcttacaaccatcgcacaaccgatttttgagttggggcaaacgacagccaaccagttactcgaccgtattgctaatccgcagcagccatgggaagaacaccacttaccagttaaattaattgaaagaaattcgacggcacatttgaattaattattcagatgtgttatatttttacgagttattaaaacgttttcataaaacgttttaataaaaactaaattcagatggtagattgcaaatttaatccgaatttttgacaaattagtcagcatcacttggtaaggtgtttgccaggtaagtactttaaggggacgctggttaatttcgagtaacgtcgttgttaaatcttgagcactaatgtgctcaaaataagtcccctttagggtaaaaataacgtaagctccgattgaaccgttcattactgccgcgttcagcgggcgtgtaagcatggcagtaataggtcggaataccgtattgtggttcaaataatactaacttgctaaactcagtgccatgatcaacagtaaagctgtgtactggtcccttaaaagttgctagaaacttagttagggcttcattaacagtcgccgctgtccgatcttttaatcggtaagcccaaagaaaacgtgatttgcgatcaattagcgttaataaagcagccttgctatgtccacgagggccaaccactgtatctatttcaaaatcaccgatgcggttacgttggttaatcacaattggtcgttgttcaattgaacgccctaatgattgattatatttagaacgttggtcaaggttacgccgttggcgtagcccatgttcaggtaattcacttaaggagaattcaattttcccctgatatagccaattataaatagattttaagtggctagtttaagctcatgcgcaatcacttctggtgaccagcttagacgtaaatggtttagaatggtttgctttaatttggcattcagtttagtttttcggccacaatgcgcccgtttatattcagcgttggcctgtgctaattcagcttgataaggttgacaacgagataattcataagaaatcgtagacggagatcgttttaaccgctcagccatttggatattggtcagtcctagctcacaaaaggtttcaattttaattcgttcagaataggttatactagacaaaagatcagctcctaaaaaatgggtttgtggtaaacaccattttaaaggaagctgatctttttgtccgaacagcgttcggattaattttacaatctaccagattaatttaactatttggagggaccattatgaatacggtaaccgttattgggagtatcaacttagaccggacgattcgggttgaaaacatgccaaagcctggcgaaacgaattcacactaaggaaatcttttcagccggtggtggtaagggcgcgaaccaggccgtcgcagcgcaacgttctggtgctaatacccactttattggtgcggttggtgacgatgctgctggtaaaaccatgcttgatttattgacgcaggaaaagatcaacttggcggggatcacaaagatgactaatcaatcgacaggtcaagcttacgtcacggttgatgatgccggtgaaaaccaaattatgattcatggtggtgccaacatggcctttacgccagcagacgtttaagcccaccgtgatatcattgaaactagtgattttgtggttgcacaatttgaaagcgctgtcgatagtacggtcgaagcctttaaaattgcacaggccgctggcgtaagaacaatcttgaatcccgctccagccatggaaaaagtccccgctgaacttttagcagttactgacatgattgtaccaaatgagacggaaacggaaactttgacttgggattgcaatcaccgatgaagccagcatgttaaaggcgtccgctgcattacacgccctcggtatttcagctgttatcattacgattggtagtaagggtgcgttttatgatatcgatgggcgacatggtatcgtaccagcttttaaagtcgaagccgtggatacgacttcagccggagatacgtttattggcgcgatgagtagtgtgttaaataaagattttagtaatcttgaagatgcgattcgctatggtaaccgggcgtcatcgattgccgtacaacgtttcggtgcgcaaccatcaattccttataaaaatgaaattacagccgcggagggtaaataattatgaaaaaaacaaaagttattaattcagatttgtcacgagttattgcaacgatgggccatttcgataagttgagtattggtgatgctggcatgccagtaccaagttcaaccgaaaaaatcgatttagccgttgataatggtattcctagttttatgcaagtcttgaataacgtcttggaagagcttgaagtacaacgaatctatttggcagaagaaattaaagttcaaaatcctaagatgttgacggccatcaagaagcgcttaccagacaccccaattaccttcattccacatgaagaaatgaagaaggacttggctgactgcaaggcctttgttcggactggtgaaatgacaccttattcaaatattttattggaaagtggcgttactttttaaagtagttggtgattaatggagggattggaatgaatactaccgctttactaattggcttagggccgttacttggttggggactttaccccacgattgcgtcgaaaattggtggtcggcctgttaatcagatcttgggttcaactattggaacgttaatctttgcgctgatttatgcatgggtgcaagggattgcttttccaagcggcatgaatctctggttttcaattctatcagggatcggttgggcaagtgcccaaatcgtgacatttaaagtgtttacgatggttggttcttcacgagcaatgccaattacgacggccttccagctgttgggcgcatcactgtggggcgtcttcgccttaggtgactggcctggggcaatggacaaggtcttgggtggcctagccttagttggaattatcattggtgcctggctaacagtgtggtctgaacataaggatgcaggtaacgcccggaccttacgccaagctgttatctggttagcagttggtgaaatcgggtactgggcttattcggctgcgctccaagcaaccaatattggtggggaggaagccttcgttccccaagcaattgggatggttattgtttcgatcgtatatgccctgttcttagcatcacgaggtgaaaagttagccctcgttgaaggggtgtcatacacgcacatcatctcaggtttcttcttcgcgtttgcggcgttgacttacttaatctctgcgcaaccaaatatgaacgcagattagcaaccggctttattctttcacaaacctccgttgtattggcaacgttaaccggtatttggttcttaggccaaaagaagactaccaaagaaatgtgggtcacgattggtggactgatactaattattgcggcagcagctgttacggtgacgatttaaaacaaattaatatggctataagactatttaatagagtcgctttgaaggagttatacgcttctttaaagcgactctatttttacggttattgattacaatggtcgattacaaaatttgctttatgatatggcgataatgaaaataattcggcataatatttatagtttatgtcagacatctaaatgtttgatgaatcattagtccattaatttaaaaagccaatgaaaaaagagtgcattaataatgtatgcgctttcgtatatatttatctgtgaagaaaagaaatgattaaggagcgattttgatgaataattcatggattaatatttcgggtaaggtatacgttgttactggggctcatccggtattggtaaagcaattgtaactgaattattgaataacggggcgattgtttataatgctgacctcaatcaaggtgatcagcaaaatgataatttacactttgttgaaaccaatgtcacagatgcggaagcggttaatcggctggtcttaaaggttgttgatgaacaaggaaaaattgacgggcttgtaaataatgctggtatcaatttgccacgtttattggctgacgccaaggatcctcacggtaagtatgaatttgcagaatcggattttgcgaaaatgtttgccgtgaacgtgaaaagcgtcttccttgtatcgcgaggcagttacccatcaattcgagaagcaacagtacggtgttattgttaatatgtcctcagaagctggacttgaaggttcacaaggacagagtgtttattcagcaactaagggagcgattaatgggttcactcgttcgtgggctaaagaattaggtgtgaacataatattcgggtcgttggtgtcgcgccaggtattatggaagctactgggctaagaacacgctcttatgaagaggcgttagcttatacccggcataaaactgttgatgacattcgggcgggctataagagtacgtcaaccacacctcttggtcggagtggcaaactatcagaagttgcggatgcagttaactatttactatcagaacgtgccagttacattaccggggttacgattaacgttgcgggaggcaagagtcgtggttaacctttaaattttagttgggggcatggtgaggcaatggataggcaaagttttgaaatattaaacttttttattaataatgatgcattgacactaagagaattacaatcccatttttctgtttcgagagtcacaattaccaagaatattcgtgcaatcaatgattatttggtgggtattgcaaaaatcaacgttaatcaagccaagttttacctagttatcaataattattctttgccatggctaagctacaaactaatttcttgaaaaaggatttagatttcaatgatccctcaaagcgacaagcaacgattttaaaagaattgttacagcaaatcacggattacgttattctggatgatttggcagaatcattggctgtgagtcgtggcactatcaataaggatttaaaagcgctcaaacaacagcttgattattaccaagtcagaattgagacaaaaactaatcgtgggattcatttagcggttgaacatgattatatgtatgcagtaattacacgaactttagtcgggaaatactacgaactggaagcaacctgggataaagcgacagatgtcaaattgcttaatcttgttaaaaacttgatcataataatgatactgtgaccatgattaaaagaaatattgcggttattaattggttacgtaaatataacattcaaatcaatgatcgtattaataactatcatccacttcttagtgatgtaacgatgggcgtccttgcggaatctagttactgagataattggtagctcgttaagcactagcgaatgggaatttatttcatacccattaaacatcagaaagctaccgaaggatgataatcagttagttcaagtgggattggtcgaagttgaggatttaatgcagtcggtttttccaatccttaagcaaaaattagatgtgaatttggactttaaacggttgttgatggagttgcgatatcatttattatttctcattaatcgggctatttttgatgtcaagtcagaaggatttatctcggtagacatgttaagtaagtatccagtttcaacggagttagcgcaattaacattatcaaccattgccactaaattgaatattcggattcgttcccaggaggttggttatttaacagtctattttcagatggagcttgaagaatacatggcagcgccaattattcatcgggttgcactagttgagcccattaatactagtatgaaaaagttgctttttatttccgagaaattgaaagaaatgttagatgatgatttgcagattgatgtttttaactcaattagtgaatgggagcagagtccagaaaaatatttactgattttttctaacagtttttaacagataatgaattaattaaccacgcgcctattattcggttgaattctatttttaatcaaggaacgttacgtgaacgtcttcaaatttcgttggttgatgaagctgttaatcaggggcagtgtcgatttgatgtcacgcagtttgatgaacaggagacctacgtcactggagtgaaaaaattaattaatcaagagatacaacatggtcaactgacaccagattttatgcaagcttggcttaatcgagagcaacaatcgagtagtatttttggtgatggggttgcattgccacacgttattgataaatctggactaaatcgaatccttgtaacagtaggagtgtttgaaaaaccggtagtattcgataatcaaaaggtaaaacgtggtttttttggtcgcaattccgtataaactagatgcaacattaagcaaaatattagcacaagtatacgatctaattcgcagtatcacagctaacagcaatatttataataacttgaaaaattatgatgaaaatcaaggattaaatcagttgatggaggcgatttaatgttaatttattttggcgtgatcctagtcagtgcgtttctattacaaggtttccttggactaagacaaattaagaatttttctaaaacctttcatcaattacgagtgttggcgccagtagcaattggcaaaaatcctaaaaattacggtcggggacactaattctattagcgataaaggatgacggcacgatcttagaggctcaaatgatgaaggggttacgatttttgcaaagtttagggaattgcatcaacttcggcagaaaaatattgcggaaattgctgcttcataccagcaattaaaacaattcgataagctaacgcgagttttgtctattggatgcctataagaactatttaaattacaaagcaaatcagctaacgccacaagatttcgatggtagtgtcaaaatttggagcctaccaatgattgaaaagctgaaatctatttattataaaggcttagcaagtttgcgaaaaaaaaaaaaagtgaacgtaaaggagcattaatactatgaaagtagtcacagatttggcctcgggctttatggggctgtttcagagtggtggtaaaacattaattggatggatgacatcaattattcctgttgtgctattgctgttagtcttgatgaacgcgattattgcctttgttggtgacaagaagatggccaagttggccagagcttcgtcaaagaatcctgtaacccgttatttaattttaccgtttgtttcggcatttatgctcggtaatcctatggcgcactcaatgggacggttcttgccagaatactataaacctagttggtatgcatcgattgctcaattttgccacactagtaatggggtattcccacatatcaatccttccgagtatttcatttggttagggattgcgcaaggggttcagaagttaggattgaatacaatggatttggcgattcgatatctattagtcggcctagtaatgaactttatcggtggttggattactgactttacaacagcctatgtctgcaaacaacaagggattaccttgtccaagaaagttgaatttaacggctaattgagagagtgaggaatgagatcatggcaaaggaatatcatagtatcaaagttgttaaaggctctggtggctggggtggccctctaattattacaccaactatcacgaagcataaatttgtttatgtcactggaggtaataaaccagcaattgttgataagattgctaagttgacaggaatggaagctgttgatggctttaagacgtcaattcctgatgaagaaacagcattagcggttgtagactgtggtggaacattaagggtgtgtggaatttatcccaagaagggtatcaaaacaattaacgtattaccgactggtaagagcggtcccttagcgcaatttatgaatgaagctaattatgtttccaatgtagatgttgatcagattatgttggtaacatctgaggaggagcaattttctgacagtcaaaatgaaagcgctaaccaatttgagaatgtagatgacgatacgaaattcgataatacaaagacactaacagcacaaacaaaaatcctgggatcttaactaagattgggattggtgctgggcgagtcgtttcgacgtttaatcaggccgcaaaagatgctgttcaaacagttattaatactattattccatttatggcatttgtggcattaattattgggattattaatggctctggaattggtaaggtttttgccagtgtcatggagccgttagcaggcaatgtctggggcttgatggttttaggatttatttgctcattaccattcttatctccatttgcttgggccaggcgcagttatcggtcaagttatcgggaccttgattggcgttgaaatcgggaaaggtaatattccaccacagtatgcattaccagcattattcgcgattaacacgcaaaatggttgtgactttattccagttggcttaggactagctgaggctgattctaagacggttgaagttggggtgccatcagtgttatatagtcggtttatcaacggcgttccgcgggtctttattgcttggattgcaagttttggattatattcaaaataaatttttagaaggtttgaggtgtattgtatgatgacaaaagagagaattatcttttcaacaaaggtcttagaaataggtgcggaatctgctgattttaaatcgattggcatggcagtattatttggtgatgaagctccagacgcattacggccttcttgctttattatcgaagttgtcccaataagtgagcaaatcacagcgggaatgaaacttgaagtcgacacaatcaagtctatcaaattacagcagttggtggtgaagtccagactaaccttggaagattaggccatacggctattagttttacgggtgcaaaggaggctaaattgcctgggacgttatatgttgagcggggcgattatcctgattttaaagtcggtagcgtggtacggattatagctgaataattaacttggcagatgctattttgctctgtgtcgaattgagttaaggtcatgttttgaaagcggtagttagttttcgaagaatggctagcttctaaacatgcagacattgttggaagtatgcccctgtaaaacatacactaattactaaaattgtttaaaaacgaatgtatgagatactaattttcaacagcgatggtggttcatcaaggcaagcagactagcgctgttgttgatctacaatgtgtttgaatcgtgattaagtggtaaaaagcatgagtttatgaccacttgaatgtaagcgtttgctatggtaatattcgtttattaaattgtgcgtaattaaattgtgcatgaaatgggggctttattatggttatgaaacaaacaaaacaaactaacatactagcaggtgcagcagttattaaagttttagaagcttggggagtagatcatttgtatggtattcctggaggttcaattaattcaattatggacgcattatcagcagaaagggatcgaatccattatattcaagtacggcatgaagaagttggtgcaatggccgccgctgctgatgctaagctaacgggtaaaatcggggtttgcttcggctcagcgggacctggtggcactcatcttatgaatgggttatatgatgcgcgtgaagaccatgtccctgttctagcacttattggtcaatttggaactactgggatgaacatggatacgttccaagaaatgaatgagaatccgatttatgcggacgttgcagattataatgtaacagccgtcaatgctgccacgttgccacatgttgttattgacgaagcaattcgacgcgcctacgcgcaccaaggtgttgcggttgtgcaaattccagtcgatttaccatggcaacagattccagctgaagattggtatgcttccgctaatagttatcaaacgcagttattaccagaacccgacgttcaagcagtgacgagattgacacagactttactcgcagctgaacggccacttatttactatggcattggagctcgtaaggctggtaaagaactcgaacaattgagtaaaacgttgaaaattccattaatgagtacgtatccagctaagggtattgtcgcggatcgttatccagcctatttgggttctgctaatcgggtggcacaaaaaccggcgaatgaggcacttgcgcaagccgacgttgttttatttgttggtaataattatccgtttgcagaagtttccaaagcgtttaaaaatacgcgttatttcttacaaattgatattgatccagctaagttaggtaacaacgacataaaacagatattgcggtacttgctgatgcacaaaaaacgctggctgcaattttagcacaggtatctgaacgggagtcgacaccttggtggcaagccaatttagccaatgttaaaaattggcgggcttatctagcttcattagaagataagcaggaagggcctttacaagcatatcaagtgctacgtgcggttaataaaattgcggagcctgatgcaatctattcgattgatgttggtgatatcaatttgaatgcgaatcgacatttgaaattaacgccatccaatcggcacattacttctaacttatttgctacgatgggagttggtattccgggagcaattgctgccaaacttaattatcctgagcggcggtgtttaatctggctggtgatggtggcgcttcgatgaccatgcaagatttggcgacgcaagttcaataccatttaccagtgattaatgttgttttcaccaactgccaatatggatttatcaaaagatgagcaggaagatactaatcagaatgattttattggcgttgaattcaatgatattgattttagtaagattgccgatggcgtgcacatgcaagcttttcgagttaataagattgagcaattacctgatgtttttgaacaagccaaagcaatcgctcagcatgaaccagttctgattgatgcggtgattacaggagatcggccactgccgctgaaaagcttcgtttagattcggcaatgagttcggcagctgatattgaagcatttaaacaacggtatgaagctcaagatttacaaccactttcaacttatttaaaacaatttggcttagatgatttgcaacatcaaattggacagggtgggttttaaattcagctactatcggtgtcttgaataagtttgattgaattaatggagattatcaaataatcttatgttgcgattaggaaagaagcctaacttatttccttaatcgcttttatgttcatgctagatgcttgctgctaaaataagtaacaatagagatggatatgggaggtgtctagatggctaatacacaattaagtgatgcgacgcatattatggcatatattgcgttgcatactgatgaccagctgaaaagtgagcatattgctagtagtttaaatacggatcctaccatggtcagaagaatgatgagtaagttaagaaaagcaggcttgttaacttcggttcgtggcgttgctagaccaacattagcttgttcgcccaatgatattaccttgaaggatatctatgtagcagtggtggctaagcgtaatttttaaacgttgaccataatacttcggagacgtgtccggtcgggtcggtaattccgcgggtgatggaaaaatactactgtgatattcagaatagtgctgaggcacgtatgtcgcgagtgacgctgcaagatattattgatgacattagcgctgttcaacaacaagcataatttaagataaagacttgacaaggatcaagttttttatttaggatatggttgtgcttaaaaagtaacaacaaaaagagggtaatggaaatgactaaaattaaagcaggacaagcattggcacaagtgttggttgactggaacattgatcatatctatggtattacagctgactcgattaataatacggtagatgggttctaccaagagaaagaccacttgaagtatattcaagtacgtcatgaagaagttggtgctttagctgccgcggcagatgctaaattaacggggacgattggtgttagctttggttcagcggggccaggcgccgttcatctcttgaacggattatacgatgccaagatggatcacgtaccggtgctagctttagtcggtcaatcagcaacatccattatgaatacgaacttctttcaagaaatgaaccaagatccaatttttgcagatgtagccgaatttcataaacaagtgacaacggctgaacagattccatacgtggttgatgaagcaattagatcagcatacgcgacccgttcggtttctgttgttatcattccagatgatttgtctggtcaagatattgagtttgatggttttaaaacggcttcacttagcggcagtcaacaggtcttaatgccgaaatcagatgatgttcagcagacgatagcggctttgaaagctgctcaacaccctgttttatggattggtaagggtgcctataatgcgcgtcaagaagttatcgcagtttctgaaaaatttagtttgccggttttgtcgacggctccagcaactggtattatgccaactgaccatcctaatttcatgggctctcgcggtcgactaggaactaaacccgcctttgaagtctcgcaagcggcagatctagttttgtttgttggtactaactttccgtttgcacgttacttgccacaaggaattaagtttattcaagtcaataacaatttagcagatttaggcaaacaacatgatgctgatattactgttcttgcagagtgcaaaagaatttttccaagcattacttcaatccgaagtgacaattaagccaactaagttcttgaaagctgctcaacgtgataagcaaaactggaaccggtggctcaagacaattgctactgatgatcaaggagggttgacggctgaaggggtgctagaagctattaaagacaatgctactgatgatgccgtctttggtctggatgttgggaataatacggaatgggcaatccgacagttaccattgaataagcaacagacttttacgatgtcggcttggtatggcacgatgggttttggtttgccagcgggtttggccgcccaattgaattatcctaagaagcaggtttggagtatttctggtgatggtggttatgccatggtgatgccagacttactaacggaagttaaatatcatttgccagtcattaacgtggttttagaaaacaaagtattaggctttattcaacatgaaaagttactcgctaatcaggcgcgcccgtatgggattgacttgattggtgctgattgggccaagatggcagacaacatgggtgcgattggttttaaagtgactaaccttaaagagttgaaagcaacgtttcagaaagttactcaactacagcagaatggtaatcaactaccaattgtgattgatgcaaaaattaaaaatgttgatccaattgatactagttttgttccagtagatccagaaaactttgatgcagatacgattgctaagtatcgtgaacgatatggtatcgctgaagcggatcaaccggcacttagccaattattaaatgaattataaagggttatgtaaaggagattagtataatgacagttattaatggatatgaacagagtgatcgtgagcaaaagttaacgattttaaatttaccatcattggaagcagctgctaaaaagatcatcccgagcggaggctttggttatattagtggtgggtcagaagacgaatggactttaaagcagaataacacaatggcctttaaccatgttcaaattgtgccacgagcattgacggatatggaacagccaagcacacagactcaagcttttggcatagatctcaaaacgcctattatgatggctccagcggccgctcaaggattggcacatgcacggggtgaagctgcgactgctgaagggatggctcaagttggggcacttatggctcagagtacttactcttcaacgtcaattgcagatactgcctcagctggtaaaggtgcgccccaatttttccaattatatatgagcaaggattgggattttaatcagagtttactggatgaagcagtgaaggctggtgctaaggcaatcattttgacagttgatgcaacagttgacggttatcgtgaagctgatattatcaacaatttccagtttccaatcccaatggctaacttgactaagttcagcgaaggggatggtaaaggaaaggtatcatggaaatctatgctgctgcggcgcaaaagagattagcccggctgatgttcggcgtattacggaatatacgaatttaccagttattgtgaaggggttcagtcaccagaagatgccttgttagcaatcggggctggtgctcaaggtatctatgtttcaaaccatggcggtcggcaattaaatggtggtccagcttcctttgatgttttacacgagattgcgcaagccgttaatgggcgcgtcccaataatttttgatagcggtgttcggcgtggctcccatgtctttaaggcgttagccaatggtgcagatctggtggcacttgctcggccgattatctatggattagcattgggtggtgcgcgtggtgtcgcttccgtagtgagtcaccttaatgatgagctgttgatcgatatgcaactagcgggaactaagacgattgaagatgttaaacgtgctaaattacttaggtagtagaagtaatgctgaatataatgtctaaaatgaatttaaaatacctgatataataacactttagcgttggttttggtggaagtaaattctgctgagatcaacgctttttattgtaataggaagatgttctgaacagaaatagctgagaaactaagacactgattgacgaattgaagctatgccggcgttgaagttaggatattgtcttaaaatgcacaaaaagcgtcctaaagcacccagctgagtttttcaagtcttaaaacggttattcagacatacttggcaatagtatactgtacacatgcgcacatgcgcgcataccagttttatttaggaggctgaatgtttcataatctagttatgatgacaaggttgtaatcatgagttttgttgtaagttatttttttcataaattaacttcaaagtttcatagtaattaggatatttagagatcgatttttgattagtaaccatcaatgcatattatactgagctgaacatgaatactagttatttagtttttactgaatagctgactccttaatgtggacttacgcccgtcaacaatgagaaaaacaaacacatagattcactgacgaataaataaacctgaattctttgaacgggagactttaatttgagtgttgaaaataattattgtaaattacaacaagcgcatgatcaaaaatgtcgagtctcattacggttttataaaacaaatgggcagatggccgagacagttggctatgtcactacgattgtaccgaaagcaattgcatttatggcaattactggtcatcggcaccttatccaactcaatagaatcattactgtgagtttacagtcccaagaccgccgttacgtcatgtaatatgttttggtttatgatttcacacgtgtgtcatgattgctagtattgatatttaagtggcaatattaacgataactagttggccttaacttgatactgggtgtgctttttgagtagtagtctcttaaattaaaattggtctggaaagtaatttgttaattcaagttctttatcaagggctattaaaatagggaaccttgtagggaaatcaattcattttatgaaattgatttctcttttgtttatgcctttaggcccggttgagtgcgctaaagcgtgcgaaacaaaaaaccacccgctttgcgggcggatggcaaaatggttaaactcaaacgcccccatcagatttagaatgtaggtgtcagagccaaacattcaaaatcgaaaggggacgtcagaaatggcgaataaactaaacagccttgcacataccaagtggctgtgtaagtaccatatcgtattcactccaaagtataggagaaaaataatttataatcaatatcgacgtgacttgcaagatgatattcgcttgctatgccagtataaaggcgtaaagatattggaaggacatatgatgccagaccacgtccacttgttggtaagcatcccacccaaattaagtgttgccagttttatgggttatttaaaaggtaaatcggccttgatgatgttcgaccagcatgcgaatttgaagtataaatttgggaaccgacacttttggtcagtcggctattacgttagcacggttgggcttaatgaagccaccatcaggaaatatattcgtgatcaagaaaaacatgatcaagcgcaggatcggttgagtgtccgggaatatgaagacccttttaagggtcaaggcaagtaataacaacaccgcttaaagcggtcgcaaaagtgacaagagcagtttggctttgatacacaaaagccagcgccttgagacgctggctagtacatagggcttatagccctggagcaaactacccgttttacgggtagttatgatttaaacaaaattattctaattatttctaattgattctataagcactttacttaacgatacataaaaatcgtgatacgattcagttgtagttttaaaggatattatggtcactaagttacacatataaatttttatggaggtgttgtaatatggcaaatttctacggaaatgatcctttttttcaacaatgatatggatgatgttttcaatcaattatttcggcgcatggataatcaaaattcggagcgtgcacggtatttagttaatggacaatcgctgacaccggatgagtttgctcaataccgagcaactggtaagctaccccaaaataataaaacaatagaagtatctaaagatggtaaacaggctgttaaaaagggggattttagaaaagttagggactaatttgacggaacaggctcgtgatggattactagatccagtgattggacgtgagaatgagattcaagaaactgcagaaattttgagtcgtaggacgaaaaataatccaatcttagttggtgatgccggtgtaggtaaaactgcagtcgtcgaaggtctggcacaagcaattgtggctggtaaagttccagaaacgattcaagataaagaaatctattcgattgatttatcgtctttggaagcaggaactcaatatcgcggttcttttgaagaaaatatattaaacagctagtaaaggaagttaaagcagctggtaatattattctattcttcgatgaaattcatcagattatcggcacgggcgccactggtggtgaagatggtggcaaaggattggctgatatcattaaacctgctttgtcacgtggcgagctgactgtaatcggggctacgactcaagatgaatatcgcaatactattttgaaaaatgcggctttggcacggcgattcaatgatgttgtgattaatgaaccgacggccgctgacactttacgtatattacaaggtgttaaaaagctgtacgaaaagcatcatcatgttgtattaccagatgatgttttgaaggcggctgtggattattcaatccaatatataccacaacgcactttgccagataaagctatcgatttgatcgacatgactgcggctcatttagcggctaaaaattcgcaaactgatgttgagacattggatcaacgcgttaaaaaattagaggcacgctaaggaggccgccgttaaatcggaggactttacaaaagccgctgatatcaagaagtcgatcgaggaaaccaagcaaaaaattaaaaaaacggatcaaaaagaaaaatcactgccacgattgatgatgtggcacaatcggttgaacgtttaactggtataccagttgctgatatgggcgctaatgatattgagcacttgaaaaatcttgataagcgtctgaaaagtaaggtaatcggtcaagatgaagcggttgaaatggtagcgaaggcaattcggcgtaaccgtgcgggcttttcagagggtgatcagccaattggaagttttctgtttgtgggcccaactggcgtaggaaagactgaattagctaagcaattagccttagatatgtttggaaataaaaatgcgattattcggctagatatgagtgaatatgctgatcgtacagctgtgtcgaaattaattggtacctcggctggatacgtaggctatgaagataacctgctaatactctaactgaacgggttcggcgtaatccatattccattgtattattagatgaaattgaaaaggctgatccacaagtattaacgttactgttacaagtgatggatgatgggcgcttaacggatggacaaggcaatgtcattaatttcaaaaatacgattattatcgctacttctaatgctggctttggtaatgaagcattaagtggtgacaagcaacgagatcagtcattaatggataagttagcaccatttttccgcccagaatttctgaaccgttttaatggaatcgtggaattttcacatctgactaagcaagacttaagtcaaattgtcgatttgatgttggcggatgtacaaaaacgttagccaaaaatccatcaaacttgaggtaactaaagcggccaaagattggctgatggaacaaggctatgatgaagcgatgggtgcgcggccattacggcgagtaattgaacaacaaattcgtgacaaggttaacggatttctaccttgaccacttagatgtcaaaaacttgaaggctgatttagtggatgctgagattgtgatatcggcagcttagcttaaatcagtgttcataaataactttatgtaagaggagattgcttgatagatctcctttttttcgttgattttcaccatttgatattaatctattgagtaatgtgaattagtgaaattaagtctagtttgacttgtaatttaaggaaaaattaagggtgagtatcgatgaaactgatttatattaacgatctttttacatgaaactttagtttcgtatgaataattaaactgatgtatctttaaatgtttatttctagtcttaaaacaatattgaataattaatctatttatgtattcttttcaattaattaatactgttttaaactgttgatacaggtatgtatttgagcattataggagtgggatatggaaaagccagaacaaaaactattgctttataaattaagcgaatctgttattcgctgcgatccaaaagaatcttccggttattcgctgcgattcaaaagaatcttcaactagaaagacggcgggcattactagttaaactaggcattgatactgtattaaatgttattcctaagctgataattactattatcttagcgttgctgctacacgagttggtcccagtgttagtttttatgggtagtttttagttttgcgtggctttgcctatggacgtcacttgaaatcggatttgttatgtacgatattaactatctttgtgtttgtgggtgtgccgtatgtgattggaactggtatttctgaagtatacagattgttattaagtttaatatttgtaataatcataagtatttttgctccagctgatacggtaaagaatcctattacatcgaagtcattgagaaaaaaattaaagcgacgggcaattggattgtcattaattttgagtttgttacaaatagttagtaataattattttggcacaatcattttaattgcgatggcattagccgcgctttattactaatgccctatgaaaggagggaaaattatgaaagaaaaatgtataaagtacttagccatctttttcaatacgtaggtactaaacagttggttatgtgctgccatgggatattattcgaaactaaaattcctgatgaattaaaaagcaaggattagtgtagatatatgttaatgattgtcttccaagaattatctatctatttgataattaaatctttgttgagaaatatatttttgtgagactttttgatgttatatttttatccgtctgtatgctgatgagttatatttttttagcaaagttaggaattagtttttctttttaatgttaatgatgtttatatttttcacttggtggtatgtacgagttctaagcggtgcactatgtataacatttcaagtgttcatatggtcgattatggttgaccatatttgtgatatattaactcgtttaatgaaagttcctaatgggtatgtggtagtgtttgtcatatattgagtgttgagtgtcgtaagcttaatttttcttaatattgtaatggatcgcacgaatttcagtcccacgtttagtaatcagagcttaaatcgcataaccgcactattattaatgataatatacttgtatattatgttgagtgaaggtctggaaaatcagttccaggttatattaagtaatttaattatattgtcagttgtaatggggttagtattggtgatttataacgaatatttaaaaatgtaagagccaaatatgaagtccaaaagcaaagaatacaaatacaaaatgatacttgctatatgaatgaaatcgaagctcactataatgagttgcgacgtttcagacatgactatcagaatatgttgatttcgatagatgaatatttgaaaactgatgatttagaaggtttacaagaatattatcaaaagaatcttgcaccggtttcaaatcgggtgttaaaagaaaaatataatcttgaagatttgagtcgggtcaaagtgaagcttcgattaagagtatcctatttagtaagttgagctatgcacaatcgcaagagattgaagttcattttgatttaaaggaaccattaattgacattaccgttaatgaattggatttagacattgcattaggaattatgttggataatgcaattgaagcatcggtaggacatgctgatggagagattatgagtgccatttttatcgaaaaaaatagtacggtgttcttgattcaaaacaatgtttttgaacagttaccacccttatggaaactgaaagaggggttattccactaagggcaagaatcggggattggattgaatagtttaagtaagattgttaatcgcaatgagaacatgatactcgaaaccagagtcttaggagcggtattcttacaacgcttgacggtgaagcgagtatctcagaatgattagtgtctatatttgcgaagatgatccgaaacaattacaacaaatacggcaaatcattactaaggtaatcgttccgatcaacagctagacatgagtatctgtttagcatgccaagatccccacgaattgttagacaaggttaatgcacagcagcctcaaaaggcaatctatgtgttagatattgcccttaattcagatattaatggtattcaactagctagccagattcgtgacatgggccggcgcagcaagattatttttatcacgacacacacggagttatctttgatggtgtttcaatatcaagttgaggcattagattttattcttaaggattttccagattccttgtatgagcgatttagcaaggttttacacgtggcacaagatcgttttcaaaccgatgaaaatgaccaagacgactatgttcaaataaaaattggtgagacggtcagatcaattaatgttaaaagcattatattttttgaaagttcaaccagtccccataaaatcgtagtccatttggatgatggtgaattagaatactatggactgttaaaggacgttcctgacatttgagagtcctaatttctatagatgtcataagtcatatgttgttaacttgaaacgcattaagtcattggacaagcacttgcgacgattaaccatggcaaatggtgaaaaagtgctttgttctgcacaagctaatcgttatctagctaaatggcttgctaaaaagtcataatagttccaaggaagtcgcccgccaaattagtaggcgactttttatgtgctacgtgatgaaaattcagcgttattcgattagaaattgcagtggtatttgtcagcattacgtgtactgggttcgttctttcctaaaccgtttaaaagtgtacttaaaacgattatcctcagattattcgtcttaaaacggtcggtatgtcccttgttcagagcctataataaagatgtgttcacggggtattggattggtcatgacagtaacgaatgcgtttagtttaaaggatgttgtgacaggcagaagttaatgtcgatcaatacgcgtgtgtgatgaattttaacgagagaggggcagattaggaatgattaggttatatacacaatcaagctgtcattcttctagagttgcacggcaatggttggaagcacatgggattgagttcaaggagaaaaattttagtgttgattcgcccacggtgcaagatctaaaacgtattttgagtttaaccgaacatggtgtagacgatattatctcagctcgatctaaagactatcctgaaattgcgcctaagttacccgaaatgccattgaatgaggcacttaaattgttgtgtgatcatccgaagttgttacgtcggcctatcatcattagtgatagtaaaattcaagttggctttaatgaagatgatattcgccaatttattccacgaccagttcggcgactaaagttcaatgcattgttgagtcgtctagatggtaatacaaggggatcacattattaataaaaggatggtcgagtagtaagctatatctaagattttttgttaattaaagagcgacaggctagacttacacgatatgagtctaacctgtcgctctttagttaataaccatgagacggcatcatcattctttataacaaaaataatatcgcgctggataacatccggtcaaaatattaatcactgataatatcagcaatattcattcccagagcattagccacgcgtgcaccgtagtttttgtcggcctcataaaattgcttgatttcgagttctttgacaccaggcaaagtaacttggcctaacgcatctttgatagtattaattaagcgttcttgctcgggttctgacattaagcgatataggtcgcccgcttgagttgtgtaatcaacttgatagcgataaggctgtgcgcgtgtttcaccacgaacagaatcaggtgaaagtgcggcatccggcacctcttctggcccatgcagtgcattaggctcgtagttgacctcagcaccttgattattaattttcatgtaaccatcacgttacaccataattatgaactggaacaaccggcttgttcacgggtaaatcttcaaagttggcacctaaccgatatcgctgtgcatctttataggagaataggcgaccttgtagtaatttgtcgggagatggttcgataccaggaacaaaatttgctggcgacatggccgcctcttcaatatcggtaaagttattagtgggattctcatttaaagttagtttgccgactttaattagtggatagtctttgtgggagatgactttagtgacatcaaaaatgtcccatttatagtttagaccttcctcatatggcaagatttggacatacatcgtccatgatgggtaatttttttcttgaattgcatcatataagtcatcttgtaaataatctaaatcttggctcattgctttttcagctgcttgagcagtcatatttttaacgccttggtctgagatgaagtgatacttaacccaaaactgttcgccattctgattaacccatttaaatagtatgggaaccgtaaccattcatggttcgataggacgcgaggaagtcctcggtcgcccattaaataagtgacctggtgcaatgattctggagaatgagcccaaaaatcccattgcatattttgcgtacgacggttcgttttaggatcccgtttttgtgaatggatgaagtcaggaaattttaaaggatcgtttacaaaaagaccggtgtgttgtttccaacgagatcataattgccttgctgagtataaaattttaaggcaaaaccgcgcacgtctcgaacggtgtcaggataacctttttcaccggcaacttgtgagaaccttaagattatgggagttttcttaccgacaccattaaataagtctgccttagtatattccccatgtcgttttcaagttcaaaaaaaccttttgctccggcccccttagcatgaacgacccgttctggaattcgttcacgatcaaaatgggctagtttttccaaaagattatagtctttctagcattaatacgggaccacgagctccgcgccgtttgggaatgttcattgttagcccatggttggccggtttccgtcgttaatttttccgtcattttaatcgcccttttcacgtaaattacaagaaagctcttgcacaatttaaacgctaacaccttaacagagtgacttcaatcattatgcacagttaagttaatcgttcatgtggcgtagtttaattttaatcagctatcaagctgtttgatattttctaggccacccggaattgtcacatgagaaatagtagcgacccatttattaaataatgtgttatatttgtctatcattatcgataattgtaaaatgataattataagaagtaatcatttatgaatcgtcttaaatattcgtgtaattctattattgtatttaagcggtttaataagtctaggagggattttatgcattggttatgggttttgatcattggtgctattattggtgcaattgcgggtgctattactaataaaggtaaatcgatggggtggattagtaatattattgccggattggttggatctgcaattggggaagctcttttgggatcatggggaccacaattagccggaatggcaattgttccttcaattattggtggtgtgattgttgttgcgataacctcatttgttctgacacggatggattagtaaggagatgattgcgatgattaaaagcattttaaagttttgtttagctgcaatcttaatcgtaagtggtgttcttattggtgggaccgtacttactgctaagggaattgataacttgggtgataaattacaagataagttacatggataaaaattaattttacaatgagccactgatgggtgtactagttgacctgttagtggcttttagtatgagtaatatcattgagttcaaggaactaaatcaagagcgacaattttaaactaccttcaatcgaataaaagtaatatttacttttattaagaatgagggtatggtggattaaaatcaaaaaagaggattggcctatgtctaaacttattgcgaaaaatgttttcagttgccaaaaatgaatttattagtgctgactacatcggctttcttattggccttagacgttattttatacaaaattgctatcggaccagcgtattttcaattatcttttggctttttgtctatggcttgtattggttatctatatggtcccatttggggtggtctcttggagatgatctccgatatattaagctttactatttttggttccggcgcgtttcagattgcctttttgttaactgcatttttaggggatttattgacggtttgtttttatatcgtaaatcagtcaattggttatccgttgtgatgacgcaaatacttgtaatgatttttgttagtctgatgatggactcatggctaatttcagtactatttggcactaattttaaagtgttattgttgggaagattggcacgcgtcatcattcagataccatttacaggtgattgctatttttacttcattaaggcgttagaaaaacgacacgtttttgatagaatgaggcttagataacatcgatggatgctacaaaaagaggttgaacatggtatgaaatgcgctacaatcgttaaacaaataagtctaacttttctattgcacttcaagtctagttcaaccttttttaatattaactggccttattatgactgcggaaaaacaatttgggtatcgatggttgagttggtacccagcaaaataaaagagcggctatgtggtgggcatgataattcccttagcagctaaattgcggacacattctgctaagtagctggcgttgtgttctggatagattggtgttgttaatgcaataggagtgaggtgatcataaggcgggcaaaactgcccacgataatttggatcataccatattttattaggatgatagccgcgaagttgcatttcatccatcactaatacatgaaattgatacaacttggtaaggggaatatttgaaaacataattaacggttgcatgatttttaccccaaccattgcctctcaatgcggcaagctcacggtgttgacctagtaattgttgtcgtggtaattgatggattaattgttcatgccatagacgcataggccacactcccttatcgaattttaaaattaacaggtgaatattaaaaggaccaactcatcattatgatgccgaatatactgatacttttgaacgggtgatgattgtaaacgacggatagttaaagtgaatattcgcaattattatagcatagcgaattgatcaatagtttagtacaagatcaaaaaaaaacggccatagcaacaactgatatgatcaaacattccttagaatgcttaccttgaaagttgggttgagtaattaaaaataacattattttatgttgtgttagcagcagttcttaattttgatcacagcggtgtttgatagatgtttgacggtatgcaaataaaagattattgttctgataaaaggaatcaatgattaataatcttgagcgtcatttttcgaatcatggcgtttttatattacaatggtcctagaaaaagtaaagttatggaggcgattaaatgagtgatttggatcagacaaacaactatcgatacgtcattgttggtggcggaatggttgctggctatgccatcaagggaattcgacaggaagatccagagggcgcaatcttagttatttcgcaagaggcggatgttccgtatgaacggccggcactgagtaaaaagctatggctagatgatgagtttactgaagagaacattcggattggtgctgaagattatcctaatgtgacttttaagttcaagacaacggttacggctattaatcggcaagataaggtcattacattgactgatagtgagcaaatcaagtatgaacagctattgctggcaactggcggagaacctcgacaaatccagggacccgctgatccacatgtgcgcttctagtctttagacagtggtcagattatcgcaagttacgtaaatttagtggtccgaacaagcgagttgtgatcattggtggtggatatgttggtacagagctcgcatcgtcactgactcaaaatgggactaaagttacgatgatttttccagaaaaagcgctgggcgagggtaaatttcctgagtccattcgggctgagtatgaagcaacgttcaaacgtaatggtgtcacactgatgagtggtcagtttgtccaatcatatcaacgccaaggtgatcatttgactctattgacaaaggatggtacggcgatcgcagccgatacgattattgttgggttaggtgtcacgccgcggattagtttggctgaagatagtagtttggatttagctgatggtggtgtgaaagttgatgagtatctcaatactagtgacccagccatctggtctgctggagatattgcctcttatccagatcacatcttgggtcggcaacggattgatagcacgtggaccacgcccgactttctggtgaattagttggccgtaatatggcgggtgctcacatgagctatcaacataccccatacttctattccatgatttttgatatttcctggcaagcaatcggtaatattgatcctaaattgcaattgatttttgatcggcgaacgcatggatcgcttgtttatttcatagatgccggtaagttagttggtgttttagtttggaatgttaaggtgaaccttgatgatgttcgcgcattgcttgcgaacgctccagccacggatgatttggtaggttccattcgagagcaagagggatagtatctggatgagacatttgcgctattgtgaatatacgtcaggacaaatcgaccatcattaacgatggttcagtaacaaatgaaaagtcagccgtaagttattttgcttacgactggcttttatttttaatgtctaaaattataaggcgctaatgaagcgttgtgcgatttcgagtggccgggtgatgacgcccccgacaacgaccgcgtggcaccctaagtcaaggcaacgtttcatcttctcgggcgtatccaccttaccttcagcgataacagggcgtgatgtggcttggaggacttcctttaagtaggcgaagtcattatcagcaatgttggcaccagtcgtggctggtgtgtagccgtgcatcgtggtcccaataatatcaaagcctaacttatccgctactttgacgttctcgatggtatcagtatcagccatcaagagggtatcagggaattctgttcgcatggtggccacaatctctgccaatttttcaccgttaggacgcggctgacccgtgacatcgcaggcaactacggcacagcccgtagcagcaacggctcgcatctctttgattgttggcgtgatgtaaacaggtgagtcgggatagtcgactttgcttaaaccaatgagcggtagatcaacttcgtcttgaatggcctgaatatcaacttaaacggaattagcgcgaatacccgcggccccagcttccttagcggcaagggccattcgtgacataataaatgaactatgcagtggttcattaggtaacgcctgacacgagataattaatgatcccttaactgtatttaagaatgtatttttcattggatagtctctccccgtattatttgtacttatgataacgttatcataaattgagtgggacgtatatgacaaggctaatcttttagtggtggaattccgctagtaattagcgtgtattgaccagagcacatttatttatcagcacaatttataaatataaaattaatgctaataaattaggagcgctagtatctgaattgatagagtcagaactaattatatgattaattgtgtttgttataatagtaatagcaaatataattgctgactgacgaaatggcgtgggataattggcttaatgatagcaataatattagcgctttggttcggtggttaagagcaacatgaagattcagacctgagtttgaataaataaataggtagtactgagtggagtagtgtatggaaaataaatatcaaaaagtcaaagatgccctgaaagaagccattctttcgggagaatatgcaattgatgcaaaattacctacggagacggaaatgatggaacgttttgccgtctcaagatatacgattcgacgagctgtaggagaccttgaaacggagcatttcatttatcgtattcaaggcgggggaatgtttgttcaagattggcataaggactggtcgagtgaacatgacagtaaaattattggtgtgattgcgacacatgttgcagattatatctttccgcaaattatttatgggattgatcaagttatttcggagggtggttactcgttgctacttggcaatacgcataataatcatcaacgtgaacgtaaaaatttgatcaatatgctcaatagcaaggttgcggggctaatcattgaaccaactcagagtgctgcttttggacaatcctaatatggacttgtatcaggaaattaaggataatggtattcccgtgttattcattaatgcaagttatcctaatttggactttcaagccgtcacaaccagtgatcaagaggccgaacagcggatgattgaatatttgtttgaaatgggtcatgagagcattctgggtatttttcaggtggatgatgctcaggggttcatcgtatgaatggttttgtgaaagcttatcaagagcagcctgagatttcatataagagtaatattttgatgtatcagtctggtgatccttttgaaaaattagcgcatcggctggatacttatctgcaaaataatgagcgaccaacagcaatcgcctgttacaatgaccaactagcaattcgggtgatggattatctcaaagggaagggattaaacattccaacagacatatccattgttggctttgatgattaccatatgtcacggtacatgagtccaggaattaccacgatgaatcatgagaagacgacgatgggcgaggatacggggcggcaaatgctacggttgttgcacaagcagccagtagagtcgatcgtctatacgcctaaactgattgttcgcacttcagtagcagacttaaattaaccctattgaacttataactgtcttaatcgaaaacggattaggacagtttttttgtgcctgaaacagccagtagccgtgataaatcgaaaaagaaataaataatttgtactgataaaacatttttgtgttgatttgtacgtataaatatattagactgtagttgttcgaaaatgaaagcgttttatcaaaaggtgaatcgtaataacgttgttaattaaaattcaactctttttgaaagggctttctaaaatggtttgcaattattaacaagtccagatatgaggaggaacaactttggataagcagaaaaaggtttccagtaaatttattttcttctttggttcgtttggtggcattctctttgggtatgacattggggtaatgacaggcgcattaccgtttctgaaaaccgattgggcattgactaatgcaacattggttgggtgggtgacatcagcagtaatgtttggcgcaatttttggtgctgcaattgccggtcagttggcggatcgactaggtcgtcggcggatgatcttgatgtcatcattgatttttgcaattggctcgattctgtgtggcttttcacctaacaacggaacttactatttgattggcatgcgaatcttcttggggttagccgtgggtgctgcttctgcactagtacctgcatatatgtctgaaatggcaccagcacgattgcgcggtagtttatctgggattaatcagaccatgattgtgtcggggatgttaatttcttacattgttgattatattctgaaggatctacccgagaatatgtcatggcggctaatgttaggattggcagcggttccagcgattattctctttctgggagtcttgaagttgccccggaatccccacggttcttaattaaagccaatcggttagacgaagcccgtcaagttttatcttttgttcgtaaaccagatgaagttgacagtgaagttaaagcgattcaatcaacagcccaaacggaggctaacaatttagaaaagacctcctgggcaaccttgttcaatgggaaatatcggtacttagtcatggcaggtgttggggttgcagcttttcaacaatttcaaggtgctaatgcaatcttttactacattccgttaatcgttgaaaaggcaaccggtagtgctgcaagttcagcactaatgtggccaattgttcaaggcatcttattagttttaggatcattactttacatttggattgctgaaaaattcaatcggcggactttattgatgttgggtggttccgtcatggcattatcattcccgctaccagctgttattaatagtttggtgccaaatgcaagtccaatgatgattgttgtcttcttatcgattttacgtggctttctactcattcacttgggcaccattgacttgggtgctcgtgggtgaagtctttccgcttgcagttcgcggtcgggcatcaggcttagcttcttcattcaattggattgggtcatgggctgtggggttattattcccaattatgacggcttcaatgtcacaagaagcagtttttgcggtgttcggtgtgatctgtgtattaggagtgctattcgttcgattctgtgttccagaaactcgtggtcactcacttgaagagattgaagcagcaggaacgaatcatcacaaacaagtacccgtacaacaagcgagtcattaattaggaggcgggtcagatgaatttagttgaaacagcccaagcgattaaaactggcaaagtttctttaggaattgagcttggctcaactcgaattaaagccgttttgatcacggacgattttaatacgattgcttcgggaagttacgtttgggaaaaccaatttgttgatgatggggtacttggacttacgcacttgaagatgtctggaccggaattcaacaaagttatacgcaattatcagcagatgtccgcagtaaatatcacatgagtttgaagcatatcaatgctattggcattagtgccatgatgcacggatacctagcatttgatcaacaagcgaaattattagttccgtttcggacttggcgtaataacattacggggcaagcagcagatgaattgaccgaattatttgatttcaacattccacaacggtggagtatcgcgcacttataccaggcaatcttaaataatgaagcgcacgttaaacaggtggacttcataacaacgctggctggctatgtaacctggaaattgtcgggtgagaaagttctaggaatcggtgatgcgtctggcgttttcccaattgatgaaacgactgacacatacaatcagacgatgttaaccaagtttagccaacttgacaaagttaaaccgtattcatgggatatccagcatattttaccgcgggttttaccagcgggagccattgctggaaagttaacggctgccggggcgagcttacttgatcagagcggcacgctcgacgctggcagtgttattgcaccgccagaaggggatgctggaacaggaatggtcggtacgaacagcgtccgtaaacgcacgggtaacatctcggtgggaacctcagcattttcgatgaacgttctagataaaccattgtctaaagtctatcgcgatattgatattgttatgacgccagatgggtcaccagttgcaatggtgcatgttaataattgttcatcagatattaatgcgtgggcaacgatttttcgtgagtttgcagcccggttgggaatggaattgaaaccggatcgattatatgaaacgttattcttgaatcaactcgcgctgatgcggatgctggagggttggctaattatagttatcaatccggtgagaatattactaagattcaagctggtcggccgctatttgtacggacaccaaacagtaaatttagtttaccgaactttatgttgacccaattatatgcggcgttcgcacccctccaacttggtatggatattcttgttaacgaagaacatgttcaaacggacgttatgattgcacagggtggattgttccgaacgccggtaattggccaacaagtattggccaacgcactgaacattccgattactgtaatgagtactgctggtgaaggcggcccatgggggatggcagtgttagccaactttgcttgtcggcaaactgcaatgaacctagaagatttcttagatcaagaagtctttaaagagccagaaagtatgacgttgagtccagaaccggaacgggtggccggatatcgtgaatttattcaacgttatcaagctggcttaccagttgaagcagcggctgggcaagcaatcaaatattagagaagagggttaataaaatgctagaagcattaaaacaagaagtttatgatggctaacatgcagcttccgaagctgggcctggttacttttacctggggcaatgtctcgggcattgaccgggaaaaaggcctattcgtgatcaagccatctggtgttgattatggtgagttaaaaccaagcgatttagtcgttgttaacttacagggtgaagtggttgaaggtaaactaaatccgtctagtgatacgccgactcatacggtgttatataacgcttttcctaatattggcggaattgtccatactcattcgccatgggcagttgcctatgcagctgcccaaatggatgtgccagctatgaacacgacccatgctgatacgttctatggtgacgtgccggccgcggatgcgctgactaaggaagaaattgaagcagattatgaaggcaacacgggtaaaaccattgtgaagacgttccaagaacggagcctcgattatgaagctgtaccagcctcattagtcagccagcacggcccatttgcttggggaccaacacgccagctaaagccgtttacaatgctaaagtgttggaagtggttgccgaagaagattatcatactgcgcaattgacccgtgcaagtagcgaattaccacaatatttattagataagcattatttacgtaagcatggtgcaagtgcctattatggtcaaaataatgcgcattctaaggatcatgcagttcgcaagtaataaggattagttgaattaaaaacatacaaatagacgaggagtgcttaattatgttatcagtacctgattatgagttttggtttgttaccggttcacaacacctttatggtgaagaacaattgaagtctgttgctaaggatgcgcaagatattgcggataaattgaatgcaagcggcaagttaccttataaagtagtctttaaggatgttatgacgacggctgaaagtatcaccaactttatgaaagaagttaattacaatgataaggtagccggtgttattacttggatgcacacattctcatccagctaagaactggattcgtggaactgaactgttacaaaaaccattattacacttagcaacgcaatatttgaataatattccatatgcagacattgactttgattacatgaaccttaaccaaagtgcccatggcgaccgcgagtatgcctacattaacgcccggttgcagaaacataataagattgtttacggctattggggcgatgaagatgtgcaagagcagattgcacgttgggaagacgtcgccgtagcgtacaatgagagctttaaagttaaggttgctcgctttggcgacacaatgcgtaatgtggccgttactgaaggtgacaaggttgaggctcaaattaagatgggctggacagttgactattatggtatcggtgacttagttgaagagatcaataaggtttcggatgctgatgttgataaggaatacgctgacttggagtctcggtatgaaatggtccaaggtgataacgatgcggacacgtataaacattcagttcgggttcaattggcacaatatctgggtattaagcggttcttagaaagaggcggttacacagcctttaccacgaactttgaagatctttggggatggagcaattacctggtctagcttcacaattattaattcgtgatgggtatggttttggtgctgaaggtgactggaagacggctgctttaggacgggttatgaagattatgtctcacaacaagcaaaccgcctttatggaagactacacgttagacttgcgtcatggtcatgaagcgatcttaggttcacacatgttggaagttgatccgtctatcgcaagtgataaaccacgggtcgaagttcatccattggatattgggggtaaagatgatcccgctcgcctagtatttactggttcagaaggtgaagcaattgatgtcaccgttgccgatttccgtgatgggttcaagatgattagctacgcggtagatgcgaataagccagaagccgaaacacctaataatttaccagttgctaagcaattatggaccccaaagatgggcttaaagaaaggtgcactagaatggatgcaagctggtggtggtcaccacacgatgctgtccttctcgttaactgaagaacaaatggaagactatgcaaccatggttggcatgactaaggcattcttaaagtaaagtgaatatcacaaaatggttgtggttacttattgtggccataaccatttttattcagaatcagaagtggagtgattagtgtgattaagagtgaaaaggccaaaatgattgctggtgagttgtttaatgtttatgacccagaactagtcggtgagcgagccatagcacggcaacaagtagaagctttcaatcagctcggtgagacgaatccccataaaagccaacaaataattaaacgattatttggcgcgactggtgataaaattgaagttcatgctacctttcgttgtgattacgggtataacctattcgttggtgaagatttctttttaattatgactgcgtgattttagatgtggccccgattaagattggaaaacactgtctattaggtcccaaagtacaaatttattctgtgaatcatcctgatgaccctcagttacgacgcaatggtgccatgggtattggtaagtctgtgaatctaggagatgatttatgggttggcggtggcgcgattatttgtccaggggtcacattgggaaataatgtgattgttgctgcggggagtgtggtcaccaagtcctttggagataacgtggttgttggtggtaatccagcgcgggtgattcgggaattatgagaaggattagtgattattattgaacgtgtaatttgaaaatgtgatctttagtgtagtcgcttatcttcttgaggtgagaaaatgcaaaataaagatttagacattgacgctcgtgtcaaaaatgcagttttagggctgccattactaaagcctgatgaacaaaatcgctgcttaggtacttttttatatgagcggatcgagcttaaaataacgtttagtgaagcaatgcgttatgattggacgacgattcttgagaaggttatgaaaaagaaacgtaattatcaactattatttaatggtcgtcttgatatggagattttgggacaatatatcagattagctaatcgatgtgcaatgccatttgcaattaagaatagtcagcattatcggcataatgctgaaagcgctgcaatcattttgtgtgctgatcatgcgctgaatcgcaaagaaattgatattatgaagcgttacccgcaatactaataatgtgcaaaaagcgactttcaaatgaattctcatttgaaagtcgcttttaatttacgctgaattattgattaaaattctacttcaatgcagtccatttccagttttcaacttctggaatatcggtcccttcagcacggatatagtcatgatgcttgtctaaaatgctgttcatctcttggatgacatgagcacccttttcgggcataagctggcgttgctaatagggcagctttgactaagtggaaacgatcgagttcgttgcgaacacgcatgtcgaatggcgtggtaatgtcgccttcttcgcggtaaccatgaacgtgtaagttatggttatggcgatcgaagaagatggtctttactaagtcgtcgtatgcatgataagcaaagataactggtttgtccttagtgaagaaagcatcaaattcagcatctgataaaccacgagggtcgtctttcttcagcttcagaagatcaacaacgttaatgaagcggatcttcatttcagggaagcgtgcatgcaagattgatacggcagctaagctttcagtcgttggttcagagccggcggttgcgaagacaacgtcgggttcttcaccatgatcagtacttgcccaatcaataacaccaaggccatcacgaactaagcgcttagcttcgtccatggtgaaccattgtggacgagggtgcttgctggcaataggattaaattaatcaattgcttgctttggatagccttatcaaaggttgcaatcaaagtattggcatcacctggaagataggcacgaacgtattcggtcttcttttcaaccaagtgtgaaatgatacctggatcttggtgagagtaaccattgtgatcttgttggaaggctgttgatgatgcaatcacattcagtgaaggtacatcagcccgccaaggggtttcttcgtgagaattccgtaaccacttgaagtgttgggttaacattgaatccacaacgcaggaatgattcataacttgcgaagaaaccgtaacgtccggttaaattgtaagcttccaacatcccttcatccatgtgttctgacaacatggagtcaataatccggccttgaggtgctaacaaagcatcattaggttcgtggattggttccatccactgacgtttggtatcttcaaaagcagcgcctagtttgttagataaggtttcgtcaggaccccagccacggaagttcttgttgtctttgttcaactcaattaaatcacggatatacttaccaagttcagtcatgtctgaaccgtcttccttaccgtgatccttgttgtccaaagcataatcatcgatatttggtgtaattaagtctttagttaacttaccgccgttagtgacggggttagcagccatacgagcttggccttcagggatgattgcggcaatttctggttttaaagtaccattttcatcaaataattcttctggtttgtatgatttgagccagtcaactaatttgtcggcgtgttccatgtgattgcgatcgacaggaattggaatttggtgagcccggaatgaaccttcaattggttcgccgtcccaactcttaggaccggtccagcccttaggtgcccggaaaacaatcattggccacttaggacgagattcatcattgttatccttggcgttcttacgaattgcgtggatttcttcaatgactttatccaattcgttttcagccatgattttgtgcatcttggcggggtctgtaccttcaacaaagtgtggatcccagcctagacctttaaagtagtcttcaagttcttcatgtgattcacgtgaaagaactgttggattagaaatcttgaagccgtttaagttcaagattggtaagactgtccgtctgtaattgggttaaggaacttgttaacttgccaagaagttgccaatggtccagtttcagattcaccatcaccaacaacggtagcggcaattaaacctggattatctaatactgcaccagcaccatgcaggattgagtagccaagttcgccaccttcatggatcgaaccaggcgtcttaggatcggcatgggaagcaaccccgcctgggaatgagaattgcttgaataagcgtttcatcccagctttgtcttgggtgattttaggatacgtttccgtataggtgccatctaagtaggagttagaaaccattacttgaccaccatgaccagtggggccttcaatgtagaacatgttcaagccatacttattgattgcccggtttaaatgggcataaataaagttttgaccagcaatcgtgccccaatggccgattggatgaactttcacgtcggtcgcctttagtggttcccgaagtaacgggttatttagtagatagagttgaccaactgagatgtagttagcagcacgccaatattcatcaacgcgttttagatattcatcagaagagtaatcaactgttttggatttaattgcttcactcattattttgcaactcctttgcaaatgtttgttttatttatcattacggttattatgatagcggtttcaattgtaaagtcaagcaatatttggcaaatttatcagtttaacatcaaaggacaaacagggaagcggtatgtaagtacccttgactgtttgtccttctattgtttatttaccgctgatcaatgagatgtcagccagccgaatttgtttcgcaagccgactatctaattgttcatcggtgataatggcgtccacgttactaatgtctgtagttttataaagtgcgtttttttcgaatttggtatgatcagccaaaataactttcatccgacaatgtgacatcatttttttgaaacttcaacttcttcgatgtagtggttggtaatgccagcttgcagatcaacgccaccacaaccaaaaatccgatatctgcatagagattatcaatgttatctaatgtaattggccctgatagagacccttcgctagttcgcatagtgccgcctaataaaacgaattgaatgtctttaacgaactgtagcgaatttaaaacgaaagtcgagttagtaataactgttaagttagttagttgactatgtttgattttttcagcgacttgaaatgccgtggtgccataatctaggaaaatggattcgccgtcatggataagtcgaagtgcattggtagcaatctctttcttctccgcaacggcttcatgctgtcgtttgccatacttggtctcattgacgctttgtggcgttgttgccccgccacgaatggcttggactagcccctgtttatctaaagtgtaaatatctttacgaacagtttcgcgagagacactaatttctttactaatatctgtgattttgattgttccttgttgccttagttggtctaggatatatttttgacgttgcatgacttccatcgggctaacctccctaaaatataaaagtattttctatttgtaataatatcatatattttgcatttatttgcatctggttttagtaaagtgaatgaaataattaatttttttcccggatttgtaagcgcttaacatactgattatataaactttgtgaatataataatttggtgttttttatgtaaattgccttgcaaagtatcgcttgcaaagagcactttaaaaagtttttaaagaaaagtattgcaaaagatttgcaaaatgatacaatttgaactgttgaaagcgatattacatttatataaatacgaagggagcgacttattttgagtgagaaccttgttgaagtaagtgattatttgagagaccaacttatttttctacacacctcttttaaaacgtcgaaggaattatttacagcgattaacgcgaaggcacaggaaaatgggtttgtaactgatcaatttttaccgaaaataatcaagcgagaatcaacttttccaactggcttgcaactggaacatcgaggtgttgcaattccacatactgacgcggatacaatcaacaaagaatttgttgccgtggttgttaatgatgctccaattgcttttagtcggatggatgatccagagcaaaaggttgatgcaaaattagtttttgtgcttggtctgaataaaccacatgctcagttagagatgctgcaagcattaatggaaattattcaagatgattcattaataaattcattggaaaatgccgagagctttaaccaaattcatcagttgttaagcataataaaagataaatagaagaaatacgaggagagattattatgaaaaaattaaatgtattagtagcttgcggtgccggaattgccacttcaacggttgttatgaaaaagttgaagatttgtttgccgaaaataatattgacgctaatttgattcaaattaagattgctgaagctgcttctaagcaggatgacgcggatatgttgatttcaacaactgtactaccaactgaatataagattccagcgattaaagcaatgggctttttaactggtcttggtgttgataaattgcaggatgaaatcttgactaaagcacgcgaaattcaagcacaataattaagagctagggttttaagcaggaggatgcattatgaaagtattatctgatgttgtacaaagcatcattaatgtcggccccagcgttatgcttcccattattatctttattgttgggttaatctttagggttaaaccgggtaaggcactcacatctgggattactgttggtatcggtatgattgggattaacctagtcatcaatttgttgacaactagtgttggtctgctgcgcgagcgatggttaaacggtttgggtttcatttaacgattattgatgctggatggcccgccgtttctgctgggacatgggcacagccgatctcagctatcatgattccaattattttagtcgttaacgttggcttaattttgttaaatcttactaaaacacttgatatcgatatttggaattactggcatatgattgcggccgcggctacggcttatgtggtgacgaaaaactggtggtttgcaattctttgcgggattatctatgaaatcgctgtcttaattattgctgataaaactgcgccaaaagtcgctgagttttatggcttggatggcattagctttccaactggttctgctgcggcttatggcctacttggtattccaattggatgggttgtcagcaaaattcctggaatcagaaaatgggagctgtggatccacaaacaattcaaaaacggtttggggtctttggtgaacccatggtcatggggattgtcattgggatgttactagcagccttaggtggttacagcgtaccgaacattttgaagcttggaatgtccatgggtggtgtgatgttcttaatgccgcgtatggttaagatcttaatggaagggttaattccaattcaagaaggtgctcaaaagttacttcaagagaagtacgggaaccggaagatttacttagggatggatgctgctctttcaaccggttcaccagctactttggcaactggactattaatggtaccaattacgttattcttagccattattttacctggtaaccgggtattgccattcggtgatttagcaacgattccattctttgctgctttgattgttcctagtcgtaaaggaaatatcgtccactctgtactctctgctactatcgtaatggtatttgcattgttgatggcaactgactttggggccaacgttgacatcaatgatgcacggtattgttgcctttccaaagggcgcatcagaggtcactaacttggatacgggtggtaacatcttgaactggttaattttgaaactatcacagttagtacaaccattatttaattaaaggattatccgtagaaaggaaaatggattatggatactgtaaaaacaactaaaactgacgaattaaagggcgctaaaactatggaggctgtcgttaagacggaatctggttacgacaatatggaactgaagcaaattccaatccctgaagtaacaggagacaaagttttattaaaagtggcctacactgggatctgcggtactgatattcatacatttaagggtcagtatgccaatgcggtgacaccacttgttttgggccatgaattttcaggtgaagttgttgaagtgggaccagatgttaaaacgctaaagcctggcgaccgggtgactagtgaaacgacttttgcaacggatgggcacatgtgtttactgccaagataaagaatataatttatgtcctaaccgtgtaggaatcggaactaaagctaatggttcaatggcaaattatgttctaactcgtgaggaaagtgctcacattttaccggataacgtttcctacaagatggctgcaatgtcggaacctttagcatcttgtgttcatgctatgtatcaaaagacaccattcacgttacacgacactttattaattatgggaccaggaccaatggggctactctcattgcagattgccaaagaaattggtgcctttgttattgtttctgggatcactaaggatgctgatcgtttacaaattgctaaagagttaggtgctgacattattgtagatacccaaaaagaagacttggccaaggtcgtgatggatgcgacagatggcgttggcgttaccaaggtttatgactgttcaggtgcaacgccagcggttaactctgcattaccattgatccgtaagggtggaaactttccaacaggttggtctttttgcaaagccgatgaatgaattagatgaacgttcaattattcagcatgaaattacgtatcgtggctcacggtcacaaaatccgtatgattgggcgattgctttacatcttgaaagcaagggtgctattaaccaagatgcaatgattacgaaggtctttgatcttgaacactggcgtgacgcttttgatgcaatgatggccggtaaagagctcaaagttatgattgcctctaatcctgatgatccagatttagcagattaaactaattgtagttgaatgacagaatattaaaattataacctccttaatttagagcgctgagatatttgtcttagcgctcttttttaaacaaattatagaagatatcttaaataatcaatgaactaaaatgacatattaattagtacacacacgaatataatagtggaattacatggaaagtgtcagtttaaagctgatgctaccaaaaacatgtaaaaattataatgggtttgtatcggtaaaaaggatagctaaatgttttgtaatgcagttatgagattatatcgttaagggtgcgggtgttgcgaaaggcatatttaaaacaataattactgaaacagaaacgaggccaagtgtctggtttctgttttgcgttaattaatattaaagttaagtataaaataatgtctgttgtaacggacggagatagatattcaaagaaatgtaagcgctgtattattaatgtgtcgaaagggggagataatcaatgagcacaaaaagggaacgcagtttgatctacttattggttaataaaaaggattttgtgactgctaagcaactggctgatgagcttcattcttccgacaagacaatttatcgtctgatttcgcaaataaatagtcaatatgatgagcggccgttaattatttcagaaagaggacgaggttataaactagattatcagcaatatcttgacagtaatcagcaaaatgtcgatcctactacgtcgtttagccactatttctccggtcgaaagaagaaataaaattatgaagcaactactgttggtggccccaaggcgtgtgcaagcagagacgttgtttgaagaatatttttaagcgtttcatcacaaatttccgacgaaaaagcattgccaaaatactacaacggtacagtctaaaattagtgaagaacagtggatatcttagtgttattggctcagagttaaatattcgtgatgcgattcaaagcttgattaatgatacaggtattgtggatttgaaccagattttacatgatgataattttcctcgtaaatatgacgttcgatttgtatttgagcaaattagatacattgaaacgaatattgagagtagtatcccgtatccatataatctaaatctgttttcacatatgtatatattgcttgatcgtgtgcgcaatacaaaaatggcagttgataaaaccaatgatcatgctctggatgagtatccgaaagtatcatcgttggacgctcggcttcttggagtaagcgaacaagttataaagaatactgaagattacattagtgtcaaactccctaagatcgaaggctactacttatatcaatatttagtatcttcacgaatagatggctttgttccgaatacagttgctgagcatagtaaggtacaagttgtaactaatgatttaatttcggctgttgaattactaacaaataagcatttccataattctgacttggtaaatcggttgagtgaacatattcgaccaatgctaaatcgtttagataatcatattaatatcaataataatttgttagatcaaataaaaattgaatatagtgcaatgtttcaggcggttaaacgtgcaatcaagcaactagctagtaaatataatttgtctgaagttgatgataatgaaattggctttttaacactgtattttgcaagtgagcttgagaaacataagaagcatatcgacactttaattatgtgaccccacgacgggcattggtacatcggaattgttgaaatcaaagatcattgctaatttttcgaaccttaatatcgtggatgttatctcgacggcttccctggatgaagccttgcgaagatatccacagattcagttagtcatctcaacggttcgacctttacatgcagtatcggttccggtagtcgttgttagtgcaatgcttaatatggaagaccgaaaaagcttaatgaggaggtcaaacatctgcaatgaaatcaaagattatgaaacttgtgctttgggattcggtggtaacgacgaaaaaagcattgtttgaccaagtagctaccttattacaagagaacgacgtgattgaatcgccaaggcgggctattaaattatggcaacaacgagaaaagatggggagtacgatgattgaccaactattggcggccccgcatgcacaagctcgttcaatcaaacgaaatacagttgttttagtgcacacgtgcaaaccaattccaacagtgggatgaacatgatgatgcgcaaaactttatcttttgttgtattcaacaagatatttctaaactagatgcggataccattacccgaacgttgaagttggcaatttctgacgattcgcaacatgcatttcaacagaatgccaaagctcaaattatcaaaatattagatttttaagggaggaaaagtatatggctgaaacaacagttacttcagttattgatagtcagacggtattaacgcatatgactgcaaccaataaagatgatgcgctgcgagaattagcagctacattaagcgatgctggttacttaaatgacacagcggggtatattcacgatgtctatcaacgggaaaaagaaggatcaacaggaattggaaactatattgctatcccacatggtaagagtgatagtgtctcgaaaattggtgtggcgattggcattttagatcatgagattgattgggaaaccattgatgaccatggtgtgaaagtaatcatattatttgcagttggtagtgatactgagggagcaaaggagcatttgaagttattatcactttttgctcgtaagcttggacgtgatgccgtaatcgaagcattgctgactgctgatagtgctaaggatgtcaaagaagcttttaacaattaggaggaaattaaaaatgaaaattgttggtgtaagtgcttgtactgtcgggattgcacatacttatattgcacaaaaaaaaatcgaaaacgctgccaaaaagcttggagatgaagtcaaaattgagacgcaaggtacgattggcattgagaatgaactaactgaagaagaagttaaaaatgctgatatcgtcttgctggcggtggatgtcaaaatctctggcgaagaacggtttgaaggtaagagaattgtcaaagtacctaccgaagttgctattaaatcaccaaacaagctagttgcgaaactacatgaggttgtttcagctaagtcataatatgtgatctatctcttgatgtgaatattgaggagatgaaagtagtgaaagaattaattggtaaagcaagatttaaggaacatttgttgacagctatttcatacatgattcctattgtttgcggtgctggttttattatagctattgggatggcatttggtggtaaatcacaagacgcattagtgattggtaaatttaactttttccaagcaatggccacaattggtggcaaagggcttggaatgctaccgatgattatttcaacggggattgcgttctcaattgctggtaaaccaggaattgcaccaggattagttactgggctagcagcgattgcaattagtgctgggtttattggtggtattatcggtggctatgttgccggatactttgcatggctggtattaacatatgtcaaagtaccgagttgggcaaaaggactgatgccaacgttgatcgttccttttcttgcttcgatagccagtgcgctattgatggtctatgtatttggaaccccccggtggcatggttcactggatggttaactagttttctcaaagggatgggttccgcttcaaatctcctcttaggtgctgttattggtgttctaagcattgttgatttcggcggtccaattaataaaacggtctttgcatttgtcttaacacttcaagcacaaggaattaacggaccagtaacggccttgcaacttgtaaatactgcaacccctattggttttggattagcattcttcattgccaaattattgcggaaaacatttatacgaaggctgaagttgaaactttaaagtcagcagtaccaatgggtgttgttaacatcgttgaaggatcaattccgatagttatgaacgacatctttcgtggtattttagcagctgcattaggtggtatgtgtggtggggccacaaccatggtacttggtgcggacgcgaccgtcccgtttggcggttttctgatgcttccaacgatgtcacatcctttggcgggcttggcagcagacaattgcaatcaatgttgtcgtaaccggagttgtttatgccttcatcaaaaagatgttcccgttgaagatgaggttaaggaagacagtattgatgatgaaaaagacattgatttagatgatattcaaatttcttaggagggaatagcacatggccaatgtacaaatttcaccgtcgctgatgacgatggatttagacaagtttaaggatcaactggaatttttagatcaacatgtggactcgtatcatattgatattatggatggacactttgttccaaacattacactttcaccatggtttattcaggaagttagaaaagtgagtcagttaccaatgtctgcacatttgatggtaacggatgcgccgttctgggtacaacaattaattgatatcaaatgtgagttcatctgcatgcctgctgaggtcattaacggcttagctttcagattgattgatcagattcatgatgccggattaaaggctggcgttgtactaagaaaatcctgaaacaccaatttcggtcattgagccatatattgcgttattagataaagtgaccatcatgacggttgatccaggatttgccggacaacggttcctagaaacaacattgcaaaagatcgtggccctgagagcgatgcgtgagaaggcaggctaccactatttaattgaaatggatggctcatctaaccgagtgcattttaaaatgatcgatgaagctgatccggatatttacattgttggtcgaagtggcttatttggacttgacgctaatatcaataaagcctggtcacagatggtcactgactatgaagaaactactggtaaaaaacttaataaataggagcacaacataatgaaatttttcttagatactgcgaatactgaagatattaaacatttcgcggaacttggtttagtagatggggtaacaacaaatccaacgttggtgtcacgtgaaggtcgtgattttgaaaccgttatcaaagaaattacgcacagattgtatcaggtccagtgtccgctgaagtaacggcaaccaaggccgaagagatgattgcccaggctcgcaacgaagttaagtgggcttcaaatattgtggtgaagattccgatgacggaagaaggcttaaaagcagtcaaggtgctgagtgaagaaggaattaagacgaatgtgacccttgtattctcagtttcgcaaggcttattagcggcaaaggctggtgctacttatatttcaccattcttaggacgtcttgatgatattggtggcagtggaattcagctagttaaggatttgcgccaagttttagatacttatggattcaagacggaaattatcgctgccagtgttcgagggccacaacatgttcaagaagctgcgttggctggtgctgatattgccacaattccggccacagtattcggtaaattatggtctcatccactgactgataagggcttagccagttttgcttcggattggaaagcatttcaagcgatcacagaaatagttgtaatgacggtttaggaggtaagtggaatgtttgataaagtagatgaattaggtgttaacacgattcgtacacttagtattgaagcgattcagaaagctaactcggggcatccaggactaccaatgggagctgcaccaatggcttacgtactatggacgaagcatttaaatattaatcccaagactcacatgaattgggtcaatcgtgatcgatttattctatctgcgagacatggttcagctatgttatacagcctgttacatttagccgggtatgatgtttcgattgatgatctcaagcattttcggcagtgggacagtcggactccggggcatccagagtatggacataccgatggcgttgaagtaactactggtccgttgggacaaggattcggtatggccgttggaatggcaatggcggaggcacatctagctgcccaatataaccgacctaattttccaattgttgatcattacacttatacaattgtcggtgatggcgacttaatggaaggaatttcgcacgaagctggttcactagctgggcatcttaagctgggaaagttaattgcactttacgattcgaacggcatttcattagatggtaagacgtcgcaagcgtttactgaaaatgttggtgacaggttcactgcttatggctggcagcatctggtggttgaagatgggaatgatcttgatgcaattgacgcggcaatcgaacttgcaaaaaagacaactgatcgtccttctttgattgaagtgaaaacggtgattggttatggcgcacctaaacaagggactaatgctgttcatggtaacccaattggtgcggatggcattaaagcagctgaaaaagtatatggctggaattactcggattttgaagtgccgtcagctgtttcagaccggtttgaagtaactattcaggaaaatggtgcgcgtgctgagcagcaatggaaacggctatttgaagaatatgaggcgaagtatccagatcaggcgcagtcttttaagcaagcgttcaacggacaattttctgatgacttgaaatctactttaccacactatcaattaacagatgcattggctagtcgggcggcaagcgctaaggcgattaacgctgctgccaaagtaatacctagcttatggggtggcgcagccgatttgtcgagttcgaacaaaacaatgattgcggaaacatcagactttcaaccagaatcctacgatggtcgtaatatttggttcggcgtacgtgaatttggcatggcggctgcgatgaacggaattgtattacatggcggcactcgggtattcggggaacattctttgtcttcactgattacttacgtgcggcagtccggttgtccgcactgcaacacgcaccggttatctacgtcttaacgcatgattcaattgcggtcggcgaggatgggccgacccacgaaccgattgaacaattagctagtttacgatgcatgccgaacgtacaagtgattcggccagctgatggtaatgagacttcagctgcgtgggagcaagcactgaaaacaactgataaaccaaccgttctggtattgagtcgacaagccttgaagactttacctgtatcagttgatacggcctttgctggcgttgaaaagggtggctatgtggtcagtgctgctcaaaaagaaataccagatggtttactaattacgactggttctgaagttaacttagcattggaggccaaagcccagttagcaaagcataatcaagatgtcgcggtcgtttcaattccgagttttgatcggtttgcgcaacaatcaccagaatatcgcgctagtgtgcttccgagcgcggtcacaagaagggtgacaattgaagctggatcaacatttggctggaatcagtatgctggcgatcatggtgctaagatcggtgtggatcgcttcggcacttcggcacctggtgacttggtacttgataaagtatggctttaatgtaactaatgttgtgaatacttatctgaaattaaaataattattgaagaaatagaaacggggcgttgctcggtttctatttcgtgttcgataaagaatgaggatggctatgatggaaaatattaagatgattgcgattgatatcgatggcacactagttaattcaaaaaagcaggtgacattgcgagtcaagcaagcgattaaaatggcgaaggaaaagaagattaaagtggttatctgcacgggacggccattaacaggtgttaaagcattgttgcgggagctggaactcgatgctcaagatgatcaatacgttgtttgttttggcggtgctgcaacctacacaactagtggcgaactgattgatgaacgaccgattagttatgaagattatattgacttggaagccctagcacgtaagttacgcttgcattttcacgcggtatctgaggatcggctgtatacggccgaccgtaatattggtgattttatacactctatgaagctaatctcgtttcaatgggtatctcatatcggacgccagaagagatgcggaatattaaactgattaaatcgatgtacgttgatgaacccgaagttttagacgctgccattaaacagcaaaaactatttgaaccattgaaaaagcgggttactttcacgaaaagtgcaccattttattacgaggccaacgctaatggtgttagtaagggcaacgctttgcaagtactctgtgaaaagttaagtttgactgctgccaatgtgatggcaattggtgatgaagctaatgatttgagcatgattaagtttgcaggacatggagtagcgatgggcaacgctatttctgaagtgaagcaagtggctgatgaaataactgtcgataatgaacatgatggggttgcaaaggctattgaagaaatcacgagataaggataagtaggtataacagcattgttatatcggctataagggttacaattgattattgactcttaaagtgtttggaatagattaaattattttagagatgatttcatgaaaaaaactttattttttcagcaatgatattatactaaaaagatgtaagcttattggcttatcaaatctaaatattattttcgaggaggattactagttatgtgtactgccataacttatcaatcttataataattacttcggtagaaatttcgattatgaaatttcatacaatgaaatggttacgattacgcctagaaaatatccactagtatttcgtaaggtggagaacttagatcaccattatgcaataattggaattactgctgatgtagaaagctacccactttactacgatgcgatgaatgaaaaaggattgtgtattgcgggattaaattttgcgaggttatgctgattataaaaaatatgatgctgataaagttaatatcacaccatttgaattaattccttggttattgggacaattttcaagtgttagagaagtgaaaaagaacatacaaaaactaaacttggttaatattaattttagtgaacaattaccattatcaccgctacattggttggttgctgataaacaggaatcgatagttattgaaagtgttaaagaaggactaaaaatttacgacaatccagtaggtgtgttaacaaacaatcctaattttgactaccaattatttaatttgaacaattatcgtgccttatcaaatagcacaccccaaaatagtttttcggaaaaagtggatttagatagttatagtagaggaatgggcggactaggattacctggagacttgtcctcaatgtctagatttgtcagagccgcttttactaaattaaactcgttgccgatgcagacagagagtggcagtgttagtcagtttttccatatactagggtctgtagaacaacaaaaagggctatgtgaagttactgacggaaagtacgaatatacaatctattcttcttgttgtgatatggacaagggagttgtattactatagaacttatgacaatagtcaaattaacagtgtcagtttaaaccatgagcacttggatacgactgaattaatttcttatccattacgatcagaagcacaatactatgcagttaactaaaagccactactgtaatagttaaaattgtttaaaagaggaaatcagtttgttatcagttgatttcctcttttatgtatcactgttttcagagtaagttccaatggctggcattgctgttaatatgacactagatgatataagttatcatgttaagctcgatggtaagttgggtttaattgatagaaaacataatagttatgagatgcttgaaacacctactaaaatacatttttaccaaattttatatgatcatgttttgaataaggggattaatttgagcgactggatagacattaagatattactgacaagtttatttaggaaaagagcacgttaatatatctaatagtaattgaaataataaacaccttaggaagtgattggtatcctaaggtgtttattaaagttaaggattaaaatattaagctactattctcgataacagctactgtcattatcgtaagtgagtttaacaacatgatcagacaattcaactgtgatctgctgataaactggttgataaccgtgatgagtgagttgcacattaaccttgttgtgatcaacggtaattgtgtaattgttccattcacctgactgatacttaaagtcacgtccattatcttgatagtgttggtaggtcccttgagtaccaaatactctaaacgtcatcgctttcaacggttcatcgctaatgtggctaacagcgggtccccatggcaaaatggtgttttgttttacaaataatggtagtttatcgagtggggtatcgactacaatatcctgattaccggcatactcagccccgttccaaaaatcaacccagttcccagctggtaaataaactaaccgcttaaattgagatttttgaacaacaggggggcaactagtatgtcgtcaccaaccatgtattcgtcattcaagtcgcgtacacgagggtcctgatcgtagtttaagacaacgggacgcatgattggtaagccagttgtggtttctttagcaaataaatcgtatagataaggaatcagacgataacgcaatttgagatacttgcgataaatgtttaacgttggctcgccaaatgcccatggttcttgttggcgagtccctaatgctgcatggttccgtaacagtggactgaaaattgccccttcaatccaccgtgtcagtaattcagatgtcgtgtctgaggcaaagccaccaatgtcagttccagtaaaactaaagccacttaatcctagattgcagagttgtgggatcatcatttggatatgtggccacatactgcggttgtcaccggtccaaacagtcgagtatttctgagttccggcgtaagctgcccgtgtgatgacaaatggtcgattgccagtttgctctttttagtccggtgtaggttgctttagccatattatggccataaacgttatgcatcttcttatgtgttgaaggcgtgtcttgatcattaaagaccgcgtcatctggaattgggccttcgaacgtagcgggttcgttcatatcgatccaaataccagcgacacctaaatcagttaaaaatttaccgttgttagcccaccactgacgaacttctggacgaccgaagtctggaaaagcagcgttacctggccatactttgttaatatagacatcaccgtcagcagatttaacgaaatagcctttttaagaccctcggcataaatgtgatagtcagaatcttgtttaacaccgggatcgatgatcgggatgaccttgagaccctgttggttcaacttggtaataaacttcttgggattaccctggtatttatccttgtcccaggtgaagacccgataaccatccatgtaatcgacgtcaaagtgaatcgcatcgcatggtaacgtcgtactttgcaaggttatctgcaattgcttgcacttcttcttgactagcactgtaaccccaccgtgattgttggtaaccgagcgtccacttttgaggtagtggcgttcgaccagttaagtaggtgtaattggtgacaatgtcttttaacgtggtaccaccaataatgtagtagtcaaggttaccttggacagctgaataaaagtagtaatggttgctttccttacccatatctaaatggctctggtaggtattgtcgaagaagataccgtaaggatgtccatttttagccccaacatcactgggattgacttgtaaatattaggtaggatctccagctggggagcggggttatcaacgttccaattatcataggcaaaaccacgtttgttcagatatccggtcttgtcaccaagtccataaagatattcatcaggtgctagcgatttaatgatttcgtagtaaccttgatcagatttagtaggtgccttagtcactgaaatggccttctgcctcagctaatcgttcatggactttgtcgacgcctttcaagtgaatgcgttcaccacgataatcggtaatcaaggcattgccatctttatcaaaggtatcaagatgccgttcggaatcgaggtgaatcgttaaagctgatgtccggataatgtaatgatcaccagcactttcaatagtgaaatcagtcgcctgaattttatgaccctcaattgcataggattcaccttgctcaccgcgattaataaagacgcggatgatttccggcgtaacaatagttaattgtaatggttgggcgaaagcaaacgtaatcgtttggccgttctgtgtgtaacttggtaatgcactcatattaaaaacactccttagtaaaatgacttttatttagttggattctctgacaaatcttcttgaggcttgtcttgcttaataatactaatggcaagtactgcgatgaacattgagataccagcaataagcatcattccagggcatcgaattaccaacgaatttaaagaccataaagctggcaacggatgcgagaatttgtggcaagcaaatcgtaccgttaaaaattccaatatatgagccttcattggcaccatctagtgaagaagtaaagatattaaagggctcgacatgcaccgtaaagaagccgataccgattaaacagaatggggcaattaataggtactggttgtgaatgaagaatacccaaacgaggccaactgcgaagctagctaagccaaagcgataccaaaactttcgcttgtatggattagtccgtgaaagaactaagaaaccatatagaacggcggccattgattgaatgaaggtcaagattccataccaattaccggcagcttgatagccagccgaagcagcattagttgtgtgccaaacgttttcggcgatagcaccagtagtataagtccacatatattgaataccaatccaggcaaatagttgaacgagggcaacttcccagaaagctttcggggcttcttttactaattgccaaataggtttggtgtgcttatgttgttcaggatcgatatgatgataaagtgcgtacgtgtcaggatcatattccttaaccgtatgaatagtatatgctgagatgcctaataaaataatggcaccaatataaaacgcaattcttacagaaagagggacaacgcctttttgcgccgtgtttgcaacaccaaagtaagttaggacgaacggtagaatagtagcaagtacgcctcctaggttactgaaagcttgttgccaagaccatgctttgtccttctgattttcattaaccatatctccaataatcatgcggaatggttgcatgcaaacattacttgataaatccataaataaaatagcaatagcaccaaatagtaatgcagcagttgaagcgtagccaaagccgaatgaaccagcatttggtaataacaccatgaccaacgccgctaatggtgcgctgaatagtaagtagggcattctacgaccaaagcgcgtccaagttcgatcagagtatttaccgactagtggttggacgaataatccagccaatggtggcagaatgaagaagagtcctagtttggtcggatcagcgccaatggtttggaaaatccgactcatctgtgatgattgtaatgagaaggccatattaaccccacaaaaaccaaaggtaattgcaaagatggtttttaatgggaggttgggcagcgaattagcaatagtggatgtcttaggcttactggaaacatcagcgattggtttattcgggtgtactgcgggttggttcatgagaatccatctccttaaaagttaatcacttttcaacagggcaatactagcacttgacgtaaacgtttacaatactgctttaataataaagtaaacgtttacgcttttgataatgattttaccggcttttagcgctataattaatttaaatcggaggggagctggaaaaatgaagccaacaatcaaaaggatattgccgctaaaactggcttttcaattgctacagtgtcacgagtgttggcgaaaaaaacagggtacatatagcgacaagactcaggagcgtattttaaaagttgctaaggatctcggctatcggaagaatacactagccatggaattggttaaaaagaagacggacgtgattgccgttattgtcaacgtcacgccgacgaatttttcaagtggaattattgatggtattcaacagcgcgcgactgagatcgggttacaggttattattctatatgctggtaatcggaataccgagttacaacatcaagcaattgtgaccgccttggaacgtactgtttcgggtattttgttaatggcgattgaaccagataaagcagacttacaattattaacagaatcaaagacaccgttttgttttgtttcgatcaatctagcagatgaacgcgtcaagtctgttagctctgacaattatcaggcggcctatttggcgacaaaagtatttaatttcgcatggtcatctgacaattggcctagccggaatcgaccattatcatacaggtagtcaacggcttgctgggtatcaagcggcgttaaaagattattcgattcatgggcaagctgaatgggtgcaacccggagattatagttatcaggctggttataatgtttttaatgcttatcaagagttgggcattactggggttgttgcagctagtgatatgacggcggccggactacaaaaggctgctcaggagagtaatgtgaagctacctggggcgctttctgttgtcagcattgatggaacgctcatctgcgatattgcgactctgcgttgacaagtgttacccagaattttgtccagattggtattgaaagtgttaattgtttggttggcaaatctgccacgcggttagtcccagtcacattggttgaacgtgagagtgttgcaactatataaagcgtactgagaaataattttagcttcgctgacctgagttaatcgagaacttgattgtcaggtcagcgaagctttttggttacaacgagattattccgtcactttaaatacgttctcattaacgttagtatattgtcggtactaagcgattgttttatgcgaaaagcagcaaagtgattctcaaatcgatgaaaccgctttatttcggatgttatactacagcaaatgaagtcgaaagtggggagactatgcaaattgataagttaacattaaaagatgtggcaacgacgaatcggcagtatctggagacgatttttgccttgggtgatggtcacatgggtgttcgggactcagtaccgtttacaggtaatcaacaagcaacactaccagtgatgctcatcaatggctattatgcgacgaatccaatcacatatggagaaagtgcctatggatatgcgaaaaatcatcaaacgattatttcattaacaagcccgcggtacttagactttgcaactgagaagacaagttctgagattcctgggtgactgggatatgacggtcgacgatgccgtgcttgattttgatacgggcgtattaacggaaaagtttcagtttgttacctccgaccaccatcattttgaactggtcgttaaatcaatgattgcgttggataattcgcatcaactattcttgaactacgaactgacttcgcttgattatacggggacgttgcggttcacgcggccgattattcatgatgtaactgcgacgacggcggacgcggacgatccgcgagtggcgcaacgacaatctgggttaaccaaccaatttataccagctgatcgtcagcagcaaatagagtggcagacgttggtagcttcaacacaccaacaaataacgcaacgggattggttgaccagctttccgacaggctttgaagtatatggcgatcatgccggttttcatggcagtggtaccatcgaagcacagacaacgctgagctggtcgtttacgcgtcaaatcagtgaaattaatcaagcggctgccggataagataacgggttggaccaacgatattgtggctcgtaatcggcagattttaacggacttttggcaacagtcgcaagtgcaaattagtgataaaaagttacaaactgggattcaatataacttgttccagttatttcaatcagctggtcgtagcgggttaacgaacattgcagctaaagggattactggaccgggctatgagggccattatttctgggataccgagatgtatatgttaccgttcttcatttatacgcagccacaaattgccaagcaactgttacattatcggtttagtatcttgccgcaagctcgagagcgggcgcggagcttgggtgtgacacggggtgcattgtacgcatggcgaacgattaatggtgaagaagcaagtgcctattttcctgctggcactgcgcaatatcacatcaatgcggacattgcgcatacggttaagttatattttgatgtcactaatgatcagaacttcttgcgggaacaaggtgcagcggttgtcctggaaaccgcacgtttctggttgcagtttggtagctggcaacagcgtgatggccggtcgcaattctgcttatacaaagtgacggggccggatgaatataccgccttggtagataataattactacacgaatcggatggctaaggaaaatatggcttttgcagcttggttacttgaaaatcattatattgacggcgatgctgatgagcaagcacagttcacaaaggcaagtacgaacatgtacctaccgtatgatcaagaacaacaagtcactgcacaagatgataattcaccaaagatgccggtatggccttttgcgacgacggcggcaacgcaatatccattgttgttacattatcacccgctcatgatttatcgtcaccgggtcaacaagcgaggcagatacgttattagcggaaatgttgtttccagaagatcaatcactggaacaattgcggcgagattacgagtactatatgaaccaattacgacgcatgattcctctttatcacgatcgattttcagtattttggcgagccgactaggtgatcatgataaggcgttcagttattatatggatacatcgttaatggatttggttgatctacaaggtaatgccaaagatgggcttcatgaagcaaatctgggcggcagttggttgggattaacgtatggatttgctgggatgtatgtcgctgacggtaagttacacattaccaatcatttaccaactcagataatgcatcttagttatcggttgcgttttcgtggtcgagtgctagaagttcaattatatcaagataaaacgcaagttaagcttgtcactggcttaccgttagcagtggtagtggctggaaaagaatatgatgtattgcaaggcgcccgtagcgaatgatgaaggattatagcgaattgaccagatggaagtaggacaaaaaaatattcacatacggttgacaccgcttacaattgttgactagtataaataacataaattaaagcgtgttactgattcgatcaggcataaacctactcatatctgtattcacagtctcttcagtgagatgtgatactctttaagtaggtttttgtttgaaaatccaggaggcgtgagtggtgaaatttctaaagaacttcaataataatgccgctttagtggtggacgatcaggatgttgaatggattgtaattggtaatggcgtaggttttggtaagcatcagggtgatcagattgatgatcagaaaattcagcggcgttttgtggcaactttgaaacagaatgttgatattgacgcttttcaagatttaaaaccccaatcgtttgtgattacaacaaaggtggttcacctagtggagccgctgttgaaggtcagttttagtgattatcagtactttgtgcttgcagaccacattgattttgcgttgaagcgagccaatgatggaatcgatgtcgataacggcacagtccgttgggaagttaaaaattgtttcctaaggagtttcacgcagccagtcaagcggtcgatttaattaatgtgacggcggacgtgatccttcctaaaagtgaagtggtttttatgacttatcatttcatcaatgctggttcagatggttccaagttgcaggaaacgattaaaatcacgaaattgatcagtggcatcattgatatcgtgcaatatcaataccagatgcatctggacccagagtccttcaattacaatcgtttcattgcgcatttacgtgcgctaatggtgcaacgcgttagccgcagtaatggaactggcagtgaattagatcagtcattactgcagttgatgcaagtaaaatatgcgcatgcctatgcaacagtggaacggatcgatacatttttacaaagtaaggctggctggcgactagagccggatgacaaagtctatttgacccttcacatctggcgcgtcacccaccgacaaaaaagtgaataaataagattattaacggtgtgttactggttatgcgggcattaacccaaatatcttttcttgagagcagcagtcactagggccctagtggcgtggtttgaagaaaggacatttgggtttttgtttactcaaattgcaattattgatttatagataaatgaggaggaacaatgatggcttatgaagatttaagtaaaaagattatcgccggagttggcggtaaggataatgttaagagcgtggttcactgcacaacccggttgcggtttaagctcaaagatgaaagcgctacccatactgatgaattaaaagatacagatggtgttattacagttgttcagtccggtggtcagtaccaagtagtcattggaaatgaagttgcagacgtttatgaaacgctcattcgcgtcggtggttttgccgatggtggtagtgtacctgatgattatgaagacggggaaaagatgagtatctttgaccggttcatcgatttgatttctggtatttttacgccgatgttaggtgttttatgtgcggctgggatgatcaaagggttcgttgcgatgtttgtcgcgttcaattggttgtcagagaattcaggaacatacaagattctctactcgatcggtgatggtttcttctatttcctaccaattgttttgggattgacagcagccaaaaagtttcatgttgatcaatttgtcggaatggcgattgggatggcactttgttatccaagtatcgtcgctttgaacagcagtaaaacagtattaagcacgctgttcagtggcagtatttttgaatcacagattcacgcgactttcttaggtattccagttgtgatgatgagctatacttcttcagtaattccaattatcttggccgtttggtttgcatctaaagttcaggcatttgcaaaacgaatcgtgccaacggtagttaagacgttcttagtcccatttattacgttattaattgcagtgccgattacctttttaattattggacccagttgcaagttggttaagtgatggtatttcaacagtgtgtgttgcaatctataacttcagtccgatcgttgctgggcttgtgatgggtgctttctggcaagttttcgttatctttggtgttcactggggttcgtagctgttatgatggccaacctagcctcacaaggctttgaccctattttaggattatcattagccgcttcgtttgcccaaactggagttgtattaggcattctattacaaacgaaaaatcaaaagacacgcggtattgctttaccagcctttatctccggtattttcggtgttacggagcacgccatttatgggttaacattgccacgtaagcgcccatttattctgagttgtgtggccgcttcaattggtggcggtattattggttttgcggtacaaaaatgtatatgatgggcggtatgggattattctcaatcccagctgcgattaattctaaaactggggtagacggctctgtatatggcttatattattgcgatggccatggccattgctgcagtccttggttttgccctacaaatgttatttggttacaagagtgttgatagtaatgacaagcaaactaaggtcgtagaaactgcggcaactgctgatccagtcatggtcggtggtgtttcagtagaaacgacaccaactggtgcagcaactaaagtagaaccaagcgtcacttacaatgcggccactaagttaagtagccccgaaacgggccaaatcatcccactaagtgaagttaaggatgaggtcttctcatcaggtgcaatgggcaaaggtgttgcaatcgaaccaactgatggtgtcttatacgctccagctgacggcgaagtagcactcgtattcccaactggacatgccgttggtttaaacacaacagatggtgctgaaatcttgatgcatattggaatggatactgtcgaattagagggcaaaggttttgaaacgctagttcaaaagggcgagacggtcaaagctggtcagccgctagtgaagtttgatattgaagcgattaaggcggcagggtatcccgttacaacgccaatggttgtgactaattctaagaactatcatgacgttaaactggcctttccagctgctacggaagttaatgcaactgaaccattattacaattagactaattaaaagggagttttcaattatgtattcaaaaacaatgccaactggctttccaaagaactttttgtggggcggcgcgactgctgccaaccaagttgaaggggttggaacgttgatgggaagggcctaacaactgctgaagttgttcagaaggctactgaccgcaaagtaatgtcgatgaacgaggttactaaagagagtgtccaagctgccattgatgatcaaacggataagctttatcctaagcgccgtggcgtcgacttctatcatcactataaggaagacattaagctattcgcggaaatgggcttcaaggtataccgcctatccttagcatgggctccggatctttcctaaaggtgatgaaactgaacctaatgaagctggtttgaagttttatgacaatgtttttgctgaatgtcacaagtatggtattgagcccctagtgaccatttcccactatgaaatgccattaaacctaacattaacgaataatggctgggcaagtcgcaagacaattgcagatttcactcgctatactgaagtgctattcaaacgctataagggtgttgtgaagtattggctaactttcaatgaaattaacgcttcaacttggggatttactggtactggtgcaattgatagtgatctaagcttacatgatcaaatgcaattacgctaccaagcgctacatcatgagtttgtttcaagtgcaattgcagttaagcagtgtcacgagattgatcctgaggcccaaattggctcaatgcttgcgcggatgcaaacttatgccaatacgcctaatccagctgatgttcgggcggcccaattgcaagatcaatttgaatgtgttctttactgacgtacaggtacgtggtgaatatccagaatatatgaaccggtactttgcagaaaacgggattgaattaacgatggcagctggcgatgaacaattgttagctgaaggcaaggtcgattacttaagttttagttactatatgacgacgattacttcggcgactgatgatgttgaacaagccagtggtaacttatcaatgggtggtaaaaatccatacttgaaatccagtgcctggggctggcagattgacccagttggtttacggattaccttgaacgagttctgggatcgctatcaggtaccattattcgttgttgagaacggcttgggtgccgaagatgaaatcagcgccgatggtaagattcatgatgattatcggattgactacttacgtcaacatattgaacagatgaaagaagcagtcaaggatggtgttgatttgatgggctacacgacctggggttgcattgatgtcattagtgcccggtacatccgaaatgtctaagcggtatggtttcatctatgtcgatcaagatgatgaaggtaatggtagtttgaagcggatgaagaaagactcatttgactggtataagaaagtaattgcttcgaatggggaagatttgagatagttattaataattgatattcagaccaatgattgattatacttgttgtaagggctatcattattagctaactagaaagggtgttgattaaatgtcagagttcccagaaggatttctatggggcggcgcgactgctgccaaccagttagaaggtggctaccaagaaggtggtcgtggcttatcgattgcggatgcgttaccaggtggcaaagaccgatttaaaatcgttagtcaaccagattttgactggacgatcgatacagataagtacacctatccgaaccatgaaggtattgatttctatcatcattacaaagaagatattgcactgtttgccgaaatgggtttcaagtgttaatcgtttctcaattgcatggtcacgaatttttccaaacggtgatgaaacgcaacctaacgaagccggattaaagttttatgatgatgtgattgacgaatgcttggccaataatattgaaccagtgattacaatctcacattatgaattgccattgaacttggccaaacggtatggtggctggaagaaccggtatttgattgaattctacgaaactttcgcgcggaccatcttaacgcgttatgcttcaaaggttaagtattggatgaccttcaacgaaatcaatagtgcggcacattttccggtgatgggccaaggattagtgccatcgacgggtgctaatgacaaaagaacgtttttcaggcatggcacaatcagtttgtggccagtgctaaggcagtcaaaatcgcccacgaattgcgagacgatattcaggttggctgtatgattctctatgccactagttatgcttatgattcgaacccagttaaccagctggctaatatttgcagcataatcaagatttcaacttcttctgtgcggatgttcaagtacgtggagcttatccgacctataccaagcgactgctggctgaatataatctgacctttgatgatctggagaccacagatggcgacttggcattactacaacaatatccagttgattatattgggtttagttattatatgtcgagcgcggtggaaaccacgggtagtgtaaccgatactgttgctggtaacctgatgggcggcgtcaagaatccatttttgaaggcgagtgactggggttggcagattgacccaaccgggttacggattgcgttaaatgagctatatgatcgctatcagaaaccgttgtttgtggttgaaaatggcctaggtgcgattgataaacctgataagaatttctatgttgaagatgattatcgcattgattatttgaagcaacatattgaagcgatggctggtgccattgatgatggcgtcgatttgatgggctagcacaccatggggttgcatcgaccttgttagtgcatcaactggcgagatgagtaagcggtatggctttatttacgtggacctagatgatcagggccacgggacgttagctcgctatcccaagaagtcgttctactggtatcaagatgtgattaagcataatgggctgacaaagaaatagaaaatttaatggatatacaaaaatattactggcagtactggccggtaatatttttttgtcaaaaatcagaataaaagtaatttagtttctttaataatatatttttgctgattttattgtaattaaattacaaaggtggtatattttatttgttgatgaaaacgctatcattcaggaggaagttatgctgggattttcagtttatttaaatgaatcgctcactaacgagagaattgcacagatgaaagcaatgaggaatgccggtttcgaaggtgtttttacttcgatgcatattccagaagatgatgcgagttgttatgtactcacgattgaaagagttgggaacagtttgccgtcagctggggctgacacttactgctgatgtctccgctaatggcttgaaacgaatatcgattgatatcaataacattcagcaattaacagatcttggtctaacagctctgcgagtagatgatggcttgaatccggcgcagattgcacaattatcacgacagctaccagtcgcactaaatgctagtacgatcagtgcgagcgatgttgctaaattacatgagtgtgatgctaattttcaacatttggaagcttggcataattattatccacgtcccgcgactggactggattatgagtggtaccaaagtaaaaataattggttaaagcaacaaggcttcactactatggcattcgtagtcggggatgaggaattacgcgggcctgtatttgctgggttacctacacttgaaggtgatcgttaccggcacccactggcctcaacattgaatttattaggaaagttggcaacccggataaagtttatatcggcgacattgctttaagcggggcggctctggaacaatttcgattgtatttccaacataatattttgcaactatccattcaaacctcaatggcaagcctttaccaagatatctggcataatcgtccagatgtcgcccgtgatgtaattcgtttggtcgaagggcgacaaaaataaagacaatgccaccgatgcagacaagaaaacgcccggtaggaacaattactgtagataattcgcgttatggtcggtatatgggtgagctagaaatcttgaaacagtcattgagtgcggacccgcgagtgaatgttgtgggacaagtggtgacgactgacttatctttattggcattaataggcagcaatcaagcggtccaatttattagaaaggatgagaagcaatgaatttggaaaagttaacgactgaaacacgtaatcaaaaaacgatggcactggatatgttatcggttaaagaaatgctggaattaaaatgaatcaggaggatcaacgagtaccagtggctgtgtctaaagaattgccacaaattgaatgtgctgttgataaaattgtagctaattttaaagctggcggtcgattaatttatatgggagcggggactagtggccgattgggtgttctagatgccgctgaatgcgtaccaacatttggcactagcccagaaatggtacaggggcttattgctggtggaatgtcagcaatgacggtggctgttgaaggtgccgaagattcaattgagctgggacagcaagacctggttgatcttcacttaacgtcccatgatactgttgttggggttgcagcaagcggtcgaacaccctacgtgattggtggattagattatgcatgcgaagtaggtgcaacaactgtaagtattgcttgtaacgctgatgctagtattagtcagcatgctcaaattccgattgaagttgaagttggaccggaaatattaacaggctcaacgcggttggaaatcaggtacggcacaaaaattagttttgaacatgttatcgactgcatcaatggtcggaatcggtaaggtctataagaacttgatggttgacgtcaaaccaacgaatgaaaagttggtagaacgtgctaaaagaattatcgttcaagctacggactgttcggatgagacagcggtgaaagtctttatgactgctgatcagaacgttaagttggccattgtaatggttttgaccaatatgagcaaagctgaagctagtgttcgattagatcatgccaacggttttgtaagacaagcagttaattaaaggaggggtttcatatggctgaagataagtatactcggattgcaaatgctatctatgcgcatgtaggtgggccacagaatattgagaagttgattcattgcatgacacgtgttcggatgacaattcgcgattactcattagttgatatggatggattaaaggctattgatggcgtgatgggagttgtccaagaaagataccttacaggttattgttggccctggaactgttgataaggttgcagacgtaatggttaagcaagttggggttggactcggggagccatttcctgatcctagcacgtttactagtgatgcaacggctactaagtctgaacatcaacgtgacaaggaaatggttgaagcgaaggctaaggaagttcacgctgcccaaaaagctaaaatcaaacaaacaccagttcgtaaagtgttgagtgccatttctagtatttttattccattaattccggtgtttgttggtgctgggttaatatctgggattgcttcaattctttctaacatgatgttagcaggagacattagtaagagctggacagattttataacagtgttaaaagtaattaatagtggactgttctcatacttagttatttatgttggtattaatagtgcaacggtttttggggctaccgctggattaggcggcgtgattggggccgttacgttgttgaacaggtgtgacaccgcaagcaccaatccacaacatcttcaatggacaagcgttgtctgctggtcaaggtgggattattggggttatctttgctgtttgggtattggcgattgttgaaaaatggctacacaaggttattccagattcaattgatatcattattacaccaactattgcgttattggttgttggggtctttacaatcttcttagttatgccgattgctggtgttatttcgaatagcttagtcggtgcgattgaatggatcctgaatgttggtggcgctatttctgggtttgtcctaggtttactcttcttaccaatggttatgtttggattacatcaaattttgacaccaattcatattgaaatgattaataaattaggaatgacaccacttctaccaattttagcaatggctggagccggtcaagttggcgcagcactggctttatggattcggtgtcgcaataacaagcaactatcaaatatgattaaacggtgctttaccggttggtgtgttaggtgttggtgaaccattaatctatggagtaaccttgccgcttggccgaccgtttattactgcatgtattggtggtggtattggaggtgccgttattggtggtctaggaaatattggtgcaactgcaatcggtccttctggcgtggctttgataccattgattgctaacggtcattggttaggttacgtgattggattattagcagcctatgctggtgggtttgttgcgacctacttctttggaatcccaagtagtgctaaaattgctaaagataaggaaggccatgttatcgaggcatagctaactaatcgagtaattgtaattgggagggcaccatatgacgagtgtcttatttacgattcataatagactagagaatttttcaaaagctgaacaaaagattggccgttatattttagaccatactaatgcggtgattaaaatgagtaccgctgaattagctgcagccacggggcgtcagcacagctacggtggcgcgatttgggaagacacttatcccagacggtgggtatccggcgttgaaactacggttgtcagctgaaagcaccgttgatcaaacgttatatgatgaaattaaccccaaagatagcttggatgctattaaatctaaactagcattgcgaatcacacatacgattgatgaaactaatcgttcattggatgatgcagccttacaagcagctagtcaattaattgctgacaaagcaagtgtttatgtttatgggttaggcgcctccaatgtagtggcaacagattttgaacaaaagttcattcgtattggaaaagctgttattcattcacaggatccgcatttgttagcggtaggtatgacaacgcaacgacaaaatgttgtgttgttactaatttctaattctggtgaaaaatcagaaagtattcgtctagctaacttggcacattcaattaatgtccctgtgattgtgctgagtagaaaggtgcaaccagtacactaggtaagttagcagatataatcttaataaatgatgacagcgaagaaaatcaaacagcacgcgctgctgctactacgtctttaatggctcaattatatgttgtggatttactttattatacttttattacgaatgattatgaacgacatattaaacaactggttgcttcacgcgaagcaattaaagaaaattttaattagaaggtgagttcattgtttgggtttaagaaaaagccagtgagtcttgatttaaaggcgattgcaagtgggaaaatggtgcccattacgcgggtccccgatgaggtttttgcacagaaaatgatgggtgatggttttgctattgagccaacgcaaggtactattacggcacccgctgacggtgaaattaagacacttgcagatacaaaacatgcagtgatgatgacaacttcagatggattggagctgttgttacatcttggattagatacggtcgaattagatggaaaaaccatttgatgccctaatcaagattggtgacaaagtcaaagcgggaacgccactagtaactatggatctcgaagcgattcgtgctgctggtaaaaaagcaacagtcattacagttgtgactaatatggacaaagtggcgaacatagaagttaattcgacggaaattgtgacggcgatggatacagtagcgaagattacgctaagctagttgagatagtttggatctattaaaagccctacacgtttttcggaaagcgctatctttttcgcttttaattaagaaataatatcgtcaaaacttttattagcttaaacttgaataagtattaagcgtactacgacgcataagatttttataaggcattatcagccaataaatagactggtagtgccttttatggtgccgttaatttgtgtgtagaacattatttaaattaacttacagtggtataaaagtgcgctagagcgtgtagtaactgatatgtattagatgtgtcatccttttattgtgacatattgttcattaataaagaaagcgttttcttatacaatgaatttgaaaacgaaagaggaggatttatcaagatggcaatgtttacaattaataatatgaatatgaacttggaaggacatacgcaagcagaaattttagttagtctagcggagttagccacgtcactgaatttagttgttgatcgtgactctttagtgaaagattatcaggagcgtgagcaagaatcaactactggatttggtaatggtattgcaataccacatgcaaaatcaaataatgttaaaactgcagctattttattcggtcgtagtactactgatattgaatggcagtcgttagacggtaaacccgtcaatacgtttattagtttgcttgtgcccgcaaatgaaggcgatgtgcacttaaaactgttagcgcagttaagtcgaaaattagtgcatcaagattttgtagagattttaaaacgaggggatacacgagaagtctttggaaattattaatcaagcaatcagttagaaaggtaggtaaatctatatggcaaatctaaaaattgtggccgttactaattgtccctgctggaattgcgcatacttacatggtagctgaagcaatcgaagaaaaggctaaatcattaggttatggggttcacgttgaaactcagggagccagcggtgttgaaaataaactgacaccagaacagattgctaccgccaactacgtcatcttagcattaggtaaaggaatgactgatgaggacaaacaacgttttaatggcaaaagggtcgttgaacttcccgtatcagaagcattaaaagagattgatacgttattcgataatatcgaggatcgggcagaaatctttacggcttcaaaagtgaaactgggcagtgagcgggatgcggttactgacggtatcatgagttatctcatggcgggtgtatccgccgcattgccatttgtaattggcggtggtttattgattgcaaattggcagcatgatggttcaatttggaatgccgaatacacctttagctaaaggtgtatcaccgtcgttggcttgggtgatcaccagtattgggaatctgggatttacttttatgattccaatcatgggtgcatatattgcgtttgcaatcggggataagccagcttttgcaccagcattcttagtaactttttggctaatgatactgacttgctaggtactcagtctggtgcggggttcttaggtgcaattgtaattgggctatccgttgggtattttgttaaatactttaaaaagtacgtcttggtaagaactttcagtctattttaggttttatgattattccttttgtaacattactagtttttgggctactgacgtattatctactggggccgttcatgggctggttaatgagtattctgttagcatttttgaagaatattccaacgtcgatgaagataggtggtggcttcctagttggttgtatgcttgcctttgatatggggggccaattaataaaacagcatggtttttcagtttttcgttactcagttctggaatttataactggtatgggattgtaggggttgtaactttgttgccaccgatggctgcggcaatttcaacttggattcgccctaaactctttacaaagcaagaacgggctgcaagttggagcgcttttcttgttggtatgacggttgccaccgaaccggcaattccatatgcgttagcagcaccattgccgatgattgcggctaatactttagccggtgggattactggggcgattacaataatgttaaatgtggagcgtatggcacctggaattggtatttttgatccgttaattggtttggagaagccgtggtattggttttacttgtctgtcataattggtctggtattgaacgtattctttattattactttcaaaacggcttggttacgtcgtcgtgagaaaaaggaacaagaaaagttagcacaggttgacgataaataagtgattatcacctgtcatagtgaaatgaccacgagcaggtgtgaataattaacacaccgcttattgttgtataaaataggagcggtaaacatgcaatatgattttaataaggttataaatcgtagagggacatacagtactcagtgggattatattcaagatcgctttggtcgttctgacattctaccattttcaatttcagatactgactttccggttcccgttggcgtccaagaggcgcttgaacagcgtattaagcatcctatttatggttatacacgctggaataatgaggattacaaaaatagtattattaattggtttagctctcaaaatcaagttactataaacccagattggattttatatagtcccagtgttgtttttcaattgccacctttattcgaatgaagtcagccgttggagaaagtgtagcggtcttcactcctatgtatgacgccttttatcatgtgattgaggataatcagcgggtagttagcgccggtcagactaggcagtgcacaacaagactatagtatcgattgggatactttgaaagctgttttaaagcaaacagcaacaaaaattttacttttgactaatccacataatcctaccgggaaggtcttttcagatgatgaattgaagcatatagttgcactatgtcaacaatataatgtctttataatttcagatgatattcataaggacattgtgtatcaaaaggcagcatatacgcctgtaaccgaatttacaactaagaatgtggtcctatgttgttcagctactaaaacttttaatacccctgggttgattggcgcatatttatttgagcctgaggctgaactacgtgagatgtttttatgtgaattaaagcaaaaaaatgctttatcatcagctagcatccttggaattgaatctcagatggctgcttataatactggaagtgactatttagtacaactcataacgtatttgcaaaataactttgattatctatctactttcttaaaaagtcagttaccagagattagatttaagcagcctgaagcgacttatttggcttggatggatgtctcgcaattggggctaacggctgaaaaactataagataaacttgttaatacgggtcgagttgggatcatgtcggggacaacatatggtgacagtcattatttacgtatgaatattgcttgtcctatttctaaattgcgggaaggactgaaaagaatggagtacggaatccgttcgtaaggtatgttgaattcacgagaattaagaattattttattactacaagagcatgatttgtctggtgaagacttggcagcactcttagagacatcacgtcgaacggttgtacgagatattgctagaattaatggtttacttcgtagtgaaagtattggctcgattgaaagtgtaaaaaaatatcatcttcttgttttaaatagggcaaatctaaatcgattactgacacagtccaaccatgtagagagtgtgttagtattgctaaatcttttagtgtctcctaatattacgatgggcgaacttattgagcgaacattcatgtcgcgacaaagtattatgaactgtattgagaagataaatcggcaatatgcaaagatattaaaaatcagattacggccacgaataggaatttctgtaagcgtcaatcatatttcaaagattgacatactagcggctttgatttcagacgatcgtcaattagtagaaaaaaaggtttaaattaattaatcagtcagaggatcttgctaagataaggatgattgttaaacaacaaataccggaaaaaatgtttgattatttaactgatttacaactaagtgcccaaattatggcttgtacactaattagtaaagataatactgtgataatgaaaagcacgctttataaagtattgctcaaaagcggtgtcccgcacttgcagtcagccacactggcagtgtttttgatgctaagaagcaattgcttaaatcatatgacaattcgtcaagtgcagttggcagttagagcgaccagatcccgttatacacttgcagcgtttaatcattcctttgttaatgagatttttaaacatctttgtcgtagcgcaatgtttccaacgattgcacccgcctctttgtcagaacagattagttatttgaaagttcaaaatccgtttgcttttgactttgcgtttgatctatcaaaaaagttgcaacagtgttttgaaagcgttcagattgatgatgaatatattgcgttgtatgttttacatgcgattgaatcgccaactgcgagaaatgtacgtacattaatgtatgcaacacaacaatctgtagcaaatatcaataaaatgattattacccagaaaatttccaatattgatattgagatggtattttcaaaggaacagttagaatcacgtctaaattatatcaattataatttagttattggcaatggcgttcatcctaacgacttacaatttgccaattaattttgatagtacattcaatggtgtcattagtcttgatgagcttgagcatcttaaaagcctgagtagtgaaagttatattcagaaaaacttgtctagctttttgcctaaaagtcatttttatcatgctcctactaaatatataaacgttaaccaaacattgaaagccgggttaacgaactttgcagaacagggactgttgaccaatgatcagagtaaggccttgctggcacgagaggcggccggaaatcaattagtattaaaccatgtttcgttgccgcacgcctccacggaattgagtgatgcatataaagtctttgcgattacttttgatggaataatgaaaattgatggtaaccccatttacttaattctaatagtacttgctaacgaaaaacgtgcagatagtgggcgggtattcagttatttatacactaggcttaaacagctcagtaatgtgcagctacaaaatgttgatacgtatgaaacgttaaattaaatatttgaagtagttgaaatgcaattagtgatatctgacagcaatatatcattgatgagatgatagaaattggcatttaacgcttgcaatcgttttccgaaaccgctatactagctaattgtaaataaggattgttaccgctaacattagctagtgggcaaaacctaattaatcgattgtattcgtgattgatagcacggatgcagtgggttattaggtttttttctttatttaggtatgagagtcgaggagcgtgcgcatgcgaatcaaaaaggtttttaataataacgtcctattggctgaaaaaaatggacgggaagttgtcttaattggtaaaggaatcgggttcaaaaagcatactggtgacgatgttgagcaacaacagattactaagatttatacgccagaaggagataattggattagtaatttccaaagcttgatggcagatattgaaccggaatattttgaagttgcttcgcaaattattgagttggcagaacaacaattgcaaacgacttttaatgtttatttgttgatttcattgactgaccatattcactttgctgtctatcggcaccaccatcagatggatattcataatgaaatcttgtgggaaactaagcgaatttatcaccgtgagtttcaagtcggtatgcaagcattggcactgattaaaaagcattttgatgtgacgttgttggaagatgaagctggatttattgcaatgaagtttgttgagaatagtatggctgactctaacactgatcaaacacttgcaatgactaagttgattaatgatattttgaatattgttaagtatcagctgtcattaacgatgccagatgagagtgttagtttgcaacgatttttagttcatctacgctttttgcggagcgtttaacgctgaaacgacctgatcaatcccaaggggcagatgatgatttcttatttgaacatttatctaagcaatacccccgagcctttgcctcaattgtgtccaaaaaatcgctgtttttgtgaagaagtcgacggaacagactgtttcggtgaatgagcgtatttacttaatcatgcacattcagcggatgttgaacgagaatcaataatatttttgggattgtaactattcgattaggcaaaacccaagtagcaaccagtcaacctgtgtttttagtgttgataacgggcctacttgggtttttgtcgttttataaagggaggaaaaagtgtatggattattcagaattagcacaatcaattcttaccaatattggtggaaaagataatattagcaaagcatggcactgtgcgaccagactacgtttcaacttaaagtcaacggacaaagcgaatactgaggcgattgaaaacttagatggtgtcattacggttgttcaaagcgcgggccagtatcaagttgttattggtaatgctgtggcgcgaggtctttgccgttttagcagatttagcaggattagcaaatcctgatactaggcggctgatgcagctactacaacggaagatacggttgaaaagcaaaacatcattaatcggtttattgcttttatctccggaatctttacgccgtttttaggtgctttggctggtgctggtattttgaaagggttgctagctttagcggttgcttttaattggatgtcaacgactagtggggcttataagatttggtattctgctggtgatgctattttttactttttacctgtttttctagcatttactgctgctaagcagttgaaggttaaccaatttgtagcggtgtcacttggtgcagctctgctatacccaactttagtaactgttatgacgaattcaacaacactacatttctttggtattccggtggttccaacaacatacacgtcaacggttatcccaattctgctggcagtttgggtattgtcgtatttagagccagtactggacaagctatttccagcggcaattcggaatattttcacgcccctctttttcattaattatcatggtgccattgacgctgttagttgtcggcccaattggggactcattggtaatggattagcaagtggtgttatggcaatttataacttcatgccaattggtgctggtgttatcatgggtgccttctggcaagtctttgttatctttggtgtacattggacgttcgtaccattgatgatgaataatattgctaagatgggttatgacccgttgttaccaattcttagtgcggccgtattattatcacaggctggtgctgcgttagctgttttttgaagtcacgagatcaaaaatgaaagcattagcagggtcttcttttgtcacggcattgtttggaattaccgaaccgacgatttacggggtaacgcttaagttaaaacgaccattctattgtgccgttgtgggtggtgcccttggtggtgcaattattggcgccgctggtacgcacgctagctcatttacactccctagcttattagcggtaccaaacttttctagggcatgggtttatgggtgaagtcattggattgattgtagcattcttaggtggtgcgatcttaacgtacttctttggattcgctcgtcaacagcgggctgattactcagtagtaagtgatcaaagtgataacacagtaatggctccggttgaagggacaattattccattgactagcgttcatgacgaagtatttgcgtctgaagcaatgggcaaaggattagccattgttccaaataaagggacggtcacagcgcccgttgatgggacaattacggcagtatatcccactggtcatgcgattggaattacggccaatagtggtgctgaaattctgattcacattggtattaatacggttcaattaaatggtcaatacttcgaaacaatggttaagcaaaaccaagtagtcaaacgtggtgatttattaactaaatttgatgtggataagatcaaaacggctggttacgatacaactgtcatggtcattatttacgaatacggctgactatcaaatggtcaagccaactgatgcgacggaggctagtgataattggattttagaattacaacctaaggagatcatggaaggagcaccagctaatgtataaaccaacttatcctaaaacgttccctaaagactttttgtggggcggagcgacagcagctaatcaagttgaaggtgcctggaatgaagcgggtaaaggcctgacaacggcagaagtagtgaaaaaaacgacggatcgcaagcatatgtcaatggatgatgtaacgatatcttcaattcaaacggcgctagatgatcaaactgatacaatgtatcctaagcgtcgaggtgttgatttttatcatcattacaaagaagatatcaaactatttgctgagatgggatttaaagtttatcgtttctctattgcttggtcgcgattatttccaaaaggtgatgaactcaagccaaattcagacggacttgctttctatgatcgagtcattgatgatgaattacgacgctatcacattcaaccattagttacactgtcacattatgaaatgcccattggattaacgcttaagcaaaatgggtgggccagccgggcaaccattgccgattttaatcggtttactgaagttgtttttaaacattttaaaggtcgcgttccgtactatttaacttttaatgaaattaataccggaacttggggtttcatgccactggagctgttgatactgagaattcggcgcatgatcagatgcagttacgttaccaagcgctgcaccatcaatttatcgctagtgcactggctaccaaacaattacatgctattgacccggatgctaagattgggtcaatgctggcaagaatgcaaacttacccagcgacacctaatcccgcagatgttcaggctgctcaagtggaagacgataagaacttattcttcacggatgttcaagctcgggggaatatccagaattcatgaatcgtttttttgcagagaatgatattattcaacttcaaatggcaccagatgatcagaagattttagcgaagtatccggttgactttattagttttagttactatatgacaacggtaactcaagctgatgcgcctgaacaagtgaacggtaatatggctactggtggtcgtaatccttaccttgaggaatccgattggggttggcaaattgatccggtggggttgcgagtgacactgaatgagatgtgggatcgctatcgtaagccattatttgttgttgaaaatgggctaggcgctctagatcaattaacaactgatcaacaagtgcatgatacgtatcgaattgactatttacgtaaacatattgcgcaaatgaaagctgcagttcaggatggcgtacaactaatgggctatacgatgtgggggccaatcgatttgattagtttttctacctcagagatgtccaagcgatatggttttatttatgttgaccaggatgatgccggcaaaggaagtctgaaacgctataagaaagattcattttactggtatcagaaggtcattaaatctaatggtgaagatctagcttaattggttaatgacggtggatttacgtggtataagaactgacttgccgctggtgtgatcaactgatgggaaatgatactgttagcatccacccagtttaaaataacatgtgaattgcagaaatttgctttgataagttggattaaactaaaaaagtctatctcgaaattattaaaatttcgagatagactttataatcagtaacatatttttactatattcaatccacaaaccggaatttactccaaggtttaataaagtcaagcagtaacagttcctcaggtgcaatccgaccaatccgattctttcggggttcacagtggggttgcaagacgatttgcaattcatttttataaatgccgaagttgtcgttgcctactaatacgtcgccacgctgaaattccacatcattatcgtgtggactgttgggcgtttccttgtaggtcacacggggcatggttgaacggatgacatttgggttaatatcgccacggcgaaaatgttgtggggtcaaggcaatggttctttcgatcgcattcgtctgagcttcaaattcaatgtgaaattgtacttggtaccgattgattgctgataatgcggccagttcggcttcactcgcacaagcgttaccgataattacatcgtcgattagtccggaagcgaagagatgcttggcctggacggcgattggtaagcgccgatcagcttctaatgttggcagaccatcgttgacgttccatggccccatcgtaccaacctgacttgccacgaaagcggcggagtgaatgccgaacttacgaaaacgttcgctacacttaacgaaaaagttgtaaggtagtgcggttccaacttggggatagaaattatggcagccataaataaatgggacgtttgcttggtagctgagaatattattcagataatcgacgtcattactcatattaagttcgatgatcaagccgtacggattatacgagagcagcgcctcggtcgcgccatcgaaaccctcatctagtcgaataccggcgacgtgtaaatcagcgaaaaactttagatctttataggaaattcctagttgtttaaaaatccgtggtgaaacgtccaaaatcgtttggtaacccaactgatttccaacgtcaatgattttctggtacttagctttggtttcggcgaccgtaccagatacttccagcatgctcataaaaattcgagtgaagccgtagtgttggcctaatttgagataagcggcgttttcttcaaagtcgctatgatcgggataaatggataaacctagttgacgcattgtcatgaattaatttcctcctgagtccaccggtgccaatagatgacggcgtgggcgttgttagttgtaatatcgttaaatgcaattgttggtattgactggtgcactgtcgtcgtcgtcgttaacgtgtcgcggaccaggcgattgtgttttaaaacggaaccagagagggcgacccgttgtggccgggactctgcaaaccgctgatataaggtaacgacttgttgtgccagtgcttgggctgacgtgactaataccgtgatggcttcagaattttgttgctcggccagtttggcgattaactgtgctaattgagcgttagtttgtcgatcttgagcgtaaaatttctggacggcggcagcaatatcggtaactttaagttgtgccaataggggagctgttagttgactagtttgaccgttatcagtctgggtcagaacctgtttaagtgcccgcttgctaatgtcataggcactgccttcgtcacctaaaacgtaaccccagccgccaacgcgcagaaattttccggcttggcggccataaacgaccgagcccgtgccggcaatcactaaggcgccgtctgctcctcgcaagaccgttcagtagggccagttttgcatccgcttatgacctgggtattagcgtggtaacgttgggtgatggtttgttggacctgatcagcccggccagcagtttcaatgccagcaattccgattaaaatcaacccaagctgactagctggaattgcggcagtgagctggtctaagacagtggttaagttagtaacggcagcagagtagtctaggacaacgttaccagggccacccgtaacgctttggactagatgctcggggctgtcgtccaagtttgaccaacgatgtgcgtgccaccacagtcaacgccaattaaatatgtcattttagacctcctcattgcagtgcgagtgcgtcacgaacgacaccgtgtgcgcgctgtaaacgctgctcggcgtcgctgacagagaccccagccaagttcatgacaatcgctgtcttaacgttttgatgagctgcagcgaatagttcgctggcttcatcggcagaaacgccggtggccagttcgatcatgtgctttgcgcgaatcacgagtttttcgttagttggtttaacgtccaccatcaagttatggtaaactttgccgatcttggccatcgaaattgtcgatagcatgttaagaaccatcttttctgctgtgccggctttcaaacgggttgaaccagcgagaacttcagggccgggggttacttcgatggcaacctgagcgtgttgactgattagtgcctgattattgcaggctagactgattgttgccgcaccgatttttgtgcgtagtccagtgcaccgataacgtaaggtgtgcgaccacttgctgccaggccgaccacggcatcattagcagttaaggccagatctttcaagtcttgtgcgcctaaattaggattatcctcagcaccttcaacggcgaccgtcatagcttgagctccgccagcaatgagtccttgaaccatctctggttcagtaccaaatgttgggacacattcagcagcgtctaaaactcctagacgaccgctagtaccagcagcgcccatgtaaattaagcggccgttagctttaaaggcagtgacgataagggcaatagcagcggcaatttgtggtagttcgggtgtgatgctttgactgactttagcgtcttcttgattcattaactgggcaattgccaggatcgacatttcgtctaagtcgttactggcgggattacgaccctcagtagtaagttggttaatatcagatttcaatcgttttccctcgtttcttaaaatatgtacaaagaggactgcagccaatgcagcagtcctcccagaatcataatcataatggctaattacggttggcgctaaagttagaccgattgtcagcaaataagcaatcatgttcattgaaagtagtcgttagtttaagcataccgtaatgacaaatccgtgtgattttggtgcaatctattattcggcaacggctgctggagctgctttttcagcatcggctttagcagcgtcttgttcagccttcaattggttacgatccccaaatcttgaagaatgggtaatagataaaggtggccacaataatattaataatacatagaacggctgctcgccagtcccaagcagtggtcatcaacgccccaattggtcctggtaatgtccatggaactaaagctaccgtccgactaacgaggtgtagaacagttgcagcccaagtgataatccccatggttaacggtgcgaggacgaatgggattgcaaagtatgggttcatgacaattggaacaccaaagataacgggttcgttgatgttgaagattcctgggataatggtaacccgtccaattgttttaccgtaagcggacttagagaaaaatgctaataagatacagagagacagtgttgccccagcaccaccaatgtagacgaaccattggaaaaattgttcagtcatgaagtgaggaaccgttgcagcagttgcacctttggaaatggcagctaagttatcgttcaggtttggataccataatggccagaagattgtggggtggctaaagcagcaccgtgaatcccgaatagccaaacaatatcagttaagaggattggtacgataactgaaagtaaattgtcacgaccaaagtaggctaatgggctgaagacccattgtaggaaagcattaacgtcaaagttcaaaccaacgtgaatgacccaagcaccaacgattaaaaagtcgcgggaatcaaagctgagaatgaagctgcaacagccggtgggactccatctggtaatgtgatgacgaggtgatgatcgcggcagatccgagtcacttcggccgttagaatcccagcgagcattgctgtaaataaccccgcagccccgaagtgtgttagcggcaccacggtggcagcggcttttagtcctaacgctttgaaagctgctggggtggtcgtaattggtttaactgccaacaatagaaagaccatcactgagacgaccccggttgaaatatggtcgaagtgataatcttcagctaatcgacccgcaaatggcaaacgcggcgtaaatagccataaaccccattgaaaaattaattggaattgctaaaccagcggcatagggtttaataaagtttgtccaagcagtaataggtagttgcgtgacgatcgtaaagaatgagccaacgatggtaactggaataataacggccattccgtctcgaatagcacgtaaataacggttggctgcgatcttactcatgacatcaaccgttttatctttccacgtacgtgaattatccataattcattcatctccttaacaaattagtaatgacaagttagtgttgaattaagtcctccccttttgatttaagttaacacattaacttgatttcatgagtgagtatagcataatataacagtatagttaacgctttcattgttgttagttaattgatatgggtaaattttgattaagtatagacatttaatgtattaagttaataataagggggacagccatgagtcgtaaagagccaatttatcgaaaccattttaagcgccttgattctggaattgaacacgaaccattttcgaaagaatgatccgttttatagcgagagtgagctacggaagaagtatcaagtcagttccacgacagtcgtgcgggtactgaatatgttagccgatcagggttatatttatcgtattcagggtaagggcagctttgtttccaaatttaatcggggactgcggtacgaattacggatacccatacatacgatgttgatgaggaacaggttgcaatcttagtggccaatcagacgacgccactaccaacacgggctaagtttacggctgaatcgacaacctggtatttagagcgattacgcgaaattagacacgcaccatttgaattttcgcagtcgtggtatttggcgacgctgattcccgccacagcaatgaagaagttacgggccgtacattcgatttatgcactaattaggaaacatgcgcagcttgatttatcacgccagccctttgagacaagaatatgcggcgaccgcgttcctaatcaacgaattgcggattatttgcacgtgagtctggatacgatggtgattaagatcgaacggtgggtatttcaaggggaagaaacgctggaatataccgttagttacatgttgcctaactattttgggctggcgctaactagtgattccaagtcggtagatcctaaccgaattcgatgatcgatgcataaagagaggagtggcacacaatgtcaattcatagcaataacttttattccaacgtgttacgacagtcagtgcaagtccaagttatcttgccggaaccagtgaacgcggtcggacaaattttaccagactacagtagtggtgaacagcaacttccaactgtgtggctgttgcatggcttaggtggggacgcaacgtcgtggttacggcgaacggaaatcgaactactggcaacgcaataccgagtagcggtcgtcatgccggaaacggggcggggattttatacgagaatatggtccatggtccacgctattgggattacttgacccacgagttaccaacacgaatgcgttatatcttcccgttgtcggcacgaccggaagacaattatttgttggggaactccatgggtggctatggggcattacgttatgcctttacctatccgcagcggtttgcggctgtcgcggcactatcaccggtgacggatctcaaaaggtttcacgtggaacaatcggcaattatgccagaccttgagctggctttctcaccagcacagatgcaagggacgccagcggatttgtcttacttggtacagcaaccgacaaactggggacgttacgtgttctaatggcgacgggtgatcaagatatgttacggtcaatggatgaagccttcaagccagagttggcggctgtatttaaagaccagtttgaatggcagttacaaccgggtcaccatgattggcggctctggaatcatcagttaccatttgcgatgcactggttgaaattaagggaggttggcgcaatgtttaatgttaaagatgagcacggccactataatttgtggcggcagacgggattagcgttattaccgctattattggcaattatcgcatatccactgctacctaatcgtgtctacgtgccaaccgctgtcaccagtctgacgccgtggggaatcaagagcaatatcttcatttatcccgtcttttgcctgattctgtggttctttatctggctatttatcttcttcaaccggttatatgaaaaaaatctcaaggtaacccgccaaaaatatcggccaatggagaactactatgtgtggagcagctgggtgttggatattctggcgactttgatggtggtggttcagatcttggtgagtgttagtcggtgagtggtttgtcaggtgtgaagttggcactatgagattaacgatattattgaatagtaaaatggctacagattgagcaatcaagttcctcaatctatagccattttactaatttttatgctgttttacatagaaaacttgcgatttcgaatcatcaaaatgataacgattacaagactgagtagcgtcacgccagtatcgatttcgaaaacatgtagaacactgacagctgtgtcatcaatgatgaagctagagactaatggacctacaaagaatgtcagtgcagtagcaaaactatagtagccagtcaccttacctttctcagctggaaagtattggcttagtaaagttaatcctaattgccaaatacctccggctgcgaagaagccaattgcaatggcagttaaccgagcaccgtcagcactagggataaccaccatttggagtaatgctaggaacgaaatcagagtgtaagcaaagatcaacttgattggcttaatgcgagttactaatgaggaggtaataaaaacggatactagtgaggccattgcataccatgaaattagtgatttagagctgtttagccccaactttaagacgctactaccctagagaagtttggtgcgtattgagagaaaatgtaaaacgtaaatgaaagtgtaaaaccaacaattattagcaaactaccatcaattaacatcgaaggctgattgccactaggattaatggttgttttaggctcgtcgctaattttagtgtgtttttgagttaatgtttgtggtgcgaagctggcaagtccaattaagatgatatctaaaaccatcacaactaccatgacgactagtgtgatttgagcgtttggctgagcagcaacaatgaacggcgggacgaattgtgcaagagacatggccgcttttactaacgaattcatgctagcagcttgctcttggaaagcatctgtcagtgctggataactagctgtatcaccaaaggaattggttgcgcccataaagagtgcagcgatgcaagcactgatgagattagtactaaagaacaggcccataagaaatagaatttgtgcaaccataccgattaacatagttcccttacgccccccaagcgatcagaaagataacccgcaatgagaattgtcaataagcggccaattccaatcattgcaatgacagttgagagccctttaacatcagtgtgccatagtgcttggaattgagtcccgtattgagacacaataatagtagccattcctaaaatagcataatttaaataaattccggcagctaatggtaaatatgtcttatgtttcatggttatatccctgcttttctttaagttccatagtatcacccaccaattcttattttcacaaagtgtgcatttttaaacgttataagcaacaaaaatggcatttttaatatccaatataaatggtgaaaaatcaatcaagtaaacggtttataattattaatatttttaattgatactaaattcacaatcgctgattcacttcaaattttaacacggtctcgagaagtgtctaataacaaaatcgcattcaatcgatagctagaagctattaatcgaatgcgatttatattggttcagagttaaatattgttaacagagagtgttttgctttgatcacgaacgaaggtgatgaactcttcaacagcgggttgaggtgtacggtgcttaagggtacccatgtacaaaattcgttgccatgttggaaatgacaatggaataatcttgactggcatggtttgaagaatagacatattaggtacaacggcaattccaaaaccgctggccactaaaccggcgatggcctgatcttcttctacggcatatgcactaatgggttgaccgccacagtcgttaaatagtttttgcataattggatgaagtccactgcgttgcgaaaaagtgatttggggataggctaatgtttctgccaaattgatactggagcggtttgccagtgggtgtgtagttggtgtgatgcaaaccatagtttgttcagcgacgggaaaaaactcgatatcgctaaagtgatccatctttgagcaaaaagcaacatcatattttgttgttacgtaaaccgttcagaatatctggggacaggccagtatcagtgttgaattgaaattggacagcggcatgggggcttagttgaagaaaacgctgggcaatatctggcaaccacttaatacttagtgttcggagtgcggcaatacgaatgggggctttttgttgatcaaaacgtttaatattagtcacacttttgtcgagtagtaggagtgcggattcgacatcactagcgaaaaccttaccagcgggagttaaagtaacactacgtccggctttttgaaagagatcaatgttcaattctgcttctaaggagtgtatggctttagttaaacttggttgtgtaatatgtaacagcttggcagtttgtgtatagttttcagttcttgataatgcgacgaagtatcgtaaatgatccaaattcattatagaaataacctcccgaagttcattctgacgggtaacgattgatactcaaaagttaacaactacggttaatataacagaaattaataacttttggctatggatagccccaactaaaagcaattggacgagtcgagtgatagcgattacatttaacttgtaaaataaattatgtgaatcacaaaacatgcatgtgtcgaatccactatttggaggaaattattatgacaaaatcacatccaattacaattagttcctggacacttggtgatcaatgtacatttgaagatcgttgcaaagcggctagtgctgctggttacgatggcattgggttacgcgctgaaacttacgtggatgccttgaacgaaggtttaacggacgatgatattctcgctattttggataagtataatattcgttgcaccgaagtcgaatatattgttcagtggtgtgaagcaccgcgcacatacgaacaaaaatataaggaacaggcgtgcttccatatgtgtgaattatttggtgtaaagcatattaataccggattgatggaagattatgatattgactatacagcaaagaagttacaagaattagcagcccgggcgggtgatttaattattgcattggaaccaatgccttacagtggcttacctaacttggacaagacttggaagattatgcaaaaagccaactgtgacaatgtatatatgttactagatatgtggcattgggtacgagccaaccaaccatatgacttgttgaccgaggaacaagcaaagcgggttatttcaattcaaattgatgatgcatatactcggccatatgctgattctatcttacgggatgaatcaatgcatgatcggttggctccaggtgctggtgatttggataccgctgggtttgtcaagatgataaaagatgcggtgttgatcctaaggtgattggtgtcgaagtaatctctgatcaatacatggctaagggtattgattacgttgcggattacacctataagcagactgtgtctgttttaaaggaagcgtggcctgaaattttaaaagacccagttcaagcttagatatttgattataaggagtgattattaatgaataataattggttaggattaacggataaagttgttgcaattacgggtgctgttggtggtatgggtaccaagttctgtgaagagtttgctaagcggggtgccaaaattgtcttgattgatatgattgcggataaaaccgaagcgtacgcaaagaaattgacagaaaagtatggcgttgaaacgttggccgttaagtgcaatacgactaacgaagaggaagttgatgctgctgttaaggccgtgactgataagtttggtgaagtcgatgtgctagttaatacggctgctattttacgcttctcaccacttgaagacttgcgtttggatgaatggcaagctgccttgaatgttaacttaacgggttacttcttaatgtcacaacggtttggtcgcgtcatgattcaacagaaacatggtgcgatggtacacatctcaaccgtagcgtcacgttatcctgaaacatatagtggggcctctatagtacaactaaagcagcggttaatatgatgtctaagcaaatggctgctgaatggggacagtatggtgttcggagtaactgtgtcttaccttgtctggttaagacgccgttatctgagaacttttacagtgatcctaaagttgaagagggccgtgagcggttagtggctagtcgccgcattgggactttggatgatattgctaatacggtcttattcatggctagtgaccgttctgactacactaatggtggtgaagtgaccgttgatggtggtttgaatatgatgatttctgacatgattccaaagccaggtggtcgtcgtcaatacgcgattgatcatcatcaaccagcgaaaaaaatagaaattaattcagttacatgaacttgtggatgagactgggacgactgtctcggtctctttctttattaattaagaggagataacaattatggaaaaacgaatttcaggtaccactggtttatttaccttactcggctctccagtaggtcattcaggttcaccggcaatgtataactttagctttcaagagcaaggattagactatgcatatttagcttttgatgttaaaaagcacaaatgccagaagagattgatgcattacgattatttaaggttcgcggtagcaacgtaacgatgccatgtaagggcgttgccgcaacacttgttgatgagttgtcaccggccgcaaagattgtgggggctattaatgtcattgttaacgataatggtaagttgacaggtcatattacggatggcattggttttgtacgcaatctgaaagagaacggtgtagatattgctggtaaaaagctagtcgtgattggtgctggtggtgctgctacggcgctacaagttcaatgtgcattagatggtgctaaatcattggctatttttaaccgtgaggacgacttttatgcgaatgccgaaaacactcaaaagaagattaaggaagcaaagccagaagtcgacgttaacgtctatcatctagaagaccaagacaagttaaaagctgagattgagcagggctgatattctggttaacgctactattgttggtatgaagccgctggacggtcaatcattagtcgatccaagctatttacgttcagacttggttgttgcggatactgtttacaacccctaaagaccaagttaattgaagacgccgaggcattaggatgcacggtagcgccggggaaaggcatgttattgtggcaaggtgatgcagcatacacactctttacaggtaaggctatgccaacggccgaatatcaagcctacgaggcacgtcaagcagctaagcagcattagaaaggggcaataaaaagatggaagcacgaattgatggacacacaactatgctaggccttttcggctcgccggttggccattcaggctcaccagcaatgtataactacagttttgaaaaggcgggtattaatgatgcatacctggcttttgacattcaggctgatgatgaaatggccagtgcgttaactaaaatgcgcgttttaaatatgcgtggtgctaacgtaacgatgccttgtaaaaaggttgctgcagaattagttgatgaattgtcaccagctgcagaattaatcggtgctgtgaatacgattgtcaataatgatggcgtgttagttggtcataatacggacggtgcgggctatgttgaaaatctacgccagcatggtgttgacccacagggaaagcgccttacggtgttaggtgctggtggtgctgctacagcaattgccgttcaaatggcactagatggcgctcaggcgattcatatctttaatcctaaggactcgttttatcaaaatgctgagttaacggctcaaaagatcatggataaagttcccgcatgccaagttactgtaggcgatattaatgaccaggaagtcttgacacaagcaattgcacaaagtgatattttggctaacgcaaccaaggccggtatggcaccgaatgttgaacaaactaatattaaggatatgaccgtttttcgttctgatttagttgtgacagatactgtttataatcctgctaccacaaaaatgttagcagatgcagctgaacatggaagcaaaacaattggcggtaaggggatgctggtttggcaaggtgccgcagcgttcaaattgtacacaggccaagaaatgcccgttgaagaagtaacgcaacggttcttctcagatgatgggggacgttaagatgacaagtaacacaaattcaaaccgtaaatattatgtaacagcattggcattgtactttgcttactttattttaggaattgcctcttcaataatgggacagtataaaactgagtttgcaaaggcgtggggcgcatccacgctggctaacggaaccattgatgttagtatggtagtttctgtcattgctgcctatggtctgggacggctgattgcttacccatttgctggtccagtctctgataggattgggcgtcggtatcagtggtttcattggaattgcgttgtacgccgtattcttttgggatgatcacagttcacagcatgtggtgggcgtatgctattggtattattaacgggattgctaattcgttcttggatacctgtgtgtcaccaagtgtgatggaaatctttcctaaatcggcctcaattgcaaatctatttacaaagtttgccataacggttgctcagtttgtattgccgttcgttattggtttggttgctagtgctcaaatgtcatatcgagtcatttttatcgggtgtggaattttaatgattgctgatgcaatcttagttctggttttaccatttcctaagcaagataaagcaactgctgaggctaaaacgactactgacaaaccgaagcatcgtttcacaccagctgcgattgcatcaattttaattggttttactagttcagcgacgtttatgatttggttgaattgcaatcaagagctaggagctagttacggaactcaaagaccccagtatcccgcaatcattttatgcggttggtgcaacggtagcggtcttattaactgctcagtttatccatatggggctgaaagagacgaccgtattagtactatatccaagtatttcaatcgtcatgttaatgttatgttatttcattaataatccagtcattctctatattggtagttttgttattggttacgctgctgctggtggggtactacaattggcgacctctacgaccattggtttctttccagatagtaaaggtctagcgacatcccttgtaatgattgcctcaagcgtggctaattatgctgtattatcagctgcggcatacttgacaaaagttaccggtgctgatgcgccacggatgataattctaatgaacattgtgattacgttaattggggttggtttagcattgattgtgaaacatggtggtcggtcaacacgtacgtcggctgcttccggtgttgaaagttaattaaaaattgcgccttcaataaaggcgcaatttttagattgatcgttcttgattagtgtaatgttgccaacaataactgcgaataaactcttggaaacggtggacggcgggtgtaataaaaccactgcgacgaacgactaagtaaatttgatgttgtaatggctgatcagctaagtgtttgatttgaacacgctcgggatttaaaagtggtaagtagggcattaacgcaacacccatattgtaacgaacaaacccagccatagtatgatcttcttctacttcataagctaccttgggctgaacgtgggctgctgataggatttggtcgattaatggtcgcaagccgctattctgtgaaaataagatcattggataaggtgctaggtcttcaacgtgtagcggatttttttgtaccgcgggatgatcatttggaacaactgcaacaatttcttgttgaactagtgggataaagtcaaagagatgggcagttagctgctcacccagtctatcgggacgttagaggctagaacgatgtcgtatttttcatcggctagtgcttgcgaggagcacaccggagtttccttgaccaagctcaaaagtaattgcttgattttcgctttgatttttgaaatgggacagtaactcaggaactagttgctgtcccagggtgtaggtaaatcctaatttaacatgaccggtatctggatccataagttgtttgacgagttcgttgccttgtgataaatcatttaaagtagcagtgacgtatttcaaataaacaccgccaattgatgttaacttgatattacggccatctgcttcaaaaagtggaacacccaattcgtgttcgagtttttgatggcataactcaacgaaggctgtgagatacctaagttttcggcagcctttgccatatgttgtgttcgagctagctctttgaaaaaaactaaatgtcttaaattcatgaggaatgctcctttactcatagataactttgatgatttaaacaactcatccatatttattatattaaactaatttgctaacataacaagtgaattgagtaacaaacagataaaaataatatttaggagtggtttttcatggcagaacgaattgatgggcatactttactgattggtttaatggcgtatccaattcgtcattcaatgtccccaactatgcataacaatgcttttgctaaattaggactaaattacgcttacttagcatttgaagtgacgaatgaaacgctgccaagtgcaattgagtcaatcagaacacttgatatgcgtggctccaatatttcaatgccaaacaagcaaaaagtgattccattgcttgataagcttgatccagcagctaaaatggtgggtgcggttaatacaattgttaatgatgatggtgttttaacaggttatacgactgatggcatcggatttatgaaagcgctcgcggatgaaggcttggatattcgcgaacataaaatgacgctagctggtgctggtggttgccgggactgcgatcgcagtgcaggctgcattggatggtgtcaaagaaatatctatttttaatatgcacgatgcaacatgggcaaatgccgaacggaacgttaaactaattaatgagcagaccgactgtcacgccactttacactcattagaagatcgtgatgatttcaaacgggaaatccaaagctcttatatctatactgattcgacaggtgttggaatgaaaccacttgaagataagacgcttgtggacgatcctagttggttcagctcagaccaaattgtgtttgatacagtatatgcaccacgaacgactaaattaatgaaggtagctcgtcaagcgaggattgaagcatgtttacaatggtttaggtatgatgcttgaacaaggtgcagcagcctttaagctgtggactggcgaagacatgccagttgattacattcatcagattctgtttagtgatgatcaggataaataattgatgacaggaggcaagttaaaagatgcaaccagcgataaagctacgaaatattgaacttggtagtggtcgacctaagttggcagtgcctatcacaggaacgacgattaatgatattttagcagcgacgacaccgattttagctgcacagccagatgtcgttgaatggcgaattgattttttcaaggatgtaattaatccagaaaagttgaaatcggccggtcagcaacttcgtcaggctttaggtgatattgccttattaactactttccgaactaaaggtgaaggcggcgaattagcactatcagatactgagtattttaaactgtgtgagacggtcttagatggtgggttcacggatgccttagatgttgagcgttaccatgacgaacaagctgttaaacaaattgttgcagcagctcatgagcatcaagtagttgtgatcatgagtaatcatgattttgataaaacgccggcggttgctgagatcgttaagcgccttactagtatggtcgattatggtgctgacgttgctaagatggctgtgatgccacaatcggtggaggatgtcttaacattactgacagcgactaatattgcacgccaaacactaccacagccagtaatcacaatgtcgatgggtgacttaggaaaagtgtcacggcttgctggtgaagtgttcggctcttgtttatcatttgcaacggtcggggcggcttcggcacctgggcaaattgcacttgaaaatttacggccggaattggaagatctgaagttaaattaaagcataactgaaagaaatcgtgaggtcagagtgatgattgggacacaaaaaagtatgtttcacaatttacgatgatgggaaccgtcatctcgctgacattatttgagccgaatcagttagcggtcgaagcggtctatgattacttgcagcggatggatggtgtcttttctgtcaatcgtgccgattcagaattagctgcgatcaatcaatatgccggtattcatccagttttggtggttagcactgaatgctttcaactagtgtcggatgctattaagtacacaaagcaatatgcggatagttttaatgtgctaattggaccgttggttaaactttggaagattggttttggtgggcatcaagtaccagcggccaagggaattagccaacgattagccttattagatacgcacgaagttatcctagatgaagcccaatcgagtatctacttgcgtcaatctggcatgcaattagatcttggtgcgattgccaaggggtattttgccgatcaggtcgttaagcagttacagcaggctggcattaccagcgctattgttaatcttggtggtaacgttaagctattaggggccaatccgctaaccgataatcggcgttggcaagttggaattcaagcacccgaagcgccacgtggctatccagcgctacaggttgaaacgccgctagaacggtagtgacgtcaggtatcttcgaacgatattttaaaattggcaatcaccgctaccaccatatccttgatccgcgaactggttatccggttgaaaatcaagttgatcaggtgtcgattataactgaacggtcagaattagctgaagtgttatcaacggtggcctactttgaagggccaaaccgtggttgtcaactaatcgaacagttgccacatacggaagcaatttttattgatcatgaacaacaggtaacagttaccagtggcttaacgccgcgacgcaaaggagtgtttactattgagtaaaaaacaaattaccggccaagcaatgggccacaacggtattatcaattatgaagttgacgtgcaagataataagattgaggatttgaaaatattaaagcattccgaaacgtcggggatctttaaccaagtcattgataaattgaaacaaaatatcattacggaacaatcattcaatgttgacacaattagtggtgcaacggtgatgacccaagcgttacttaagtcggcagataaggctgtaacccgatgctggtgttgatgtgcagccagttcctaagaaaaaagcccccaagacgcaaaacttgcggaccgacgtgctcattattggtggcggagaagcgggcttagtcgctggctgtcgagcgttgacaatgggtcagaaggttatcttagttgaaaagaacggctatcttggtggtgcgacgattctgaatggttctaacgttgttggtaccgggtctgatgttgctgcgcaaatttttgataataatcatgatacgccagaaatgttggcacaagatgttgctcgtgaaagcttggagacgaactatccagctttgaccgacctaatggtgcataacattggtccagccattgattttattagtaagtttgcagatttacattatcaaaaagcacagacgcaaacgccagaacattcgattaaccgtcagattgaactaccttcagcaagtagctatgaattcattcaaaaagtttcgaaggcgtttgctgctgcgggtggtcaaattatgttggatactcgagtcgagaagcttatgttggacaacgataaaaagttacgcggtgtgattgctgctcaaaaggaccaaacagtcaacatcaaggcacgttcagttgtgcttgctgcggtggtcatggcgctaaccaaaagatgcgtggtactgaaagcgaaggcattgattattatggcccaatgacttccactggggatgcctatcaatttaatggtgatttggatttgcaaacgcacgatttaggttggtacaagctgtatccacatggtgttgaagtggaaccaggcgttgctaaattgaccacgtacgcgtcgaaacaagcaactgatatgggtgcaatttacgttaactctaagggtgatcgaatcgttaacgaatcaaatgtttatacgacttttcggaatgccatccttaaacaagcggataaagttgcttacctagtaatggatgaacggacttggaagaaagtttacgacctactgatccctgctgcatgatttcacaccagaagaaattaagagcttctttgagaataagggtaaacggccagtatttgttaagggttctttggaaagtgctgctgagcaggccggaattgtggttgatgaattagtccaaacggtcaaaaattatcaaggctatgttcaagatggtcacgatcatgatttcggtcgtgatccgaagtacttgcaccaatttgaaggtgaaacattctacatcattgaacaacgtgatcgctttgcgacgactttaggtggctatagtgttgatgctgataacttgcaattggtaacgactaaaaatgcaccggtagctaattactttggtgcgggggaaatcatcggcggcgctaacggacatgattcaatgccaagtatgatgaatacttggggatttcgtcgggttacgttgccggcgccgcggctagcgaaaacgctcagcggcggcaaccgcgggcgatgacgaagccaatattgtggccattgtggggactaacgcttcaaaatcatataaccgtaagttgttgtatgccatgaaagaattatttgaaacgcaagttaattttgaaatttgtgaaattaaagatttaccgctattcaatgaagatgatatggatcgggaaccggcaagtgtaaaagcgttagccgctaagattgaagccgctgatggtgtcgtctttggcgtgccagaatatgatcattcgattccagctgccttgaagagtgccattgaatggctgtcctgtgcagaacatccattcaaagacaaaccagtgatgattgttgggacttcgttaggtattcaaggtacggtacgtgctcagatgaacttacgacagattttggactcacccggtgtggatgccaaagttatgcctggtaacgagttcatgttacctcaagccggcaataagtttgatgagaacgatcatctgaatgatgacggtagtgaacacttcttgaagcagtgctttgggcactttctttagaggggcttgaattagcatctaagaagacagtgacgaattaactactgtctagactaaaagaacgtacacaactcgtgtacgttcttttagtctagattttagttgttaaatcttttgttccacatcgtcgattgtgacaaccagggtcgcgcgaatccaatcaaacttagtatgcatttgatcgaaataagcgccactagtttcaaacttgccggtaccatgaatgtggaaaccacagccagtaccagttgtgccgggaaccttgtaactaccgacagcaattgtaatgtggttgtcggtagcaaaatcggcctcaattgagtgcatgccagccgatgggatcaatagggtatgatcatcaataagctgcatataatgactccaggtgttgacgacgtgtgctggtgcggcgttgaccgtgacgatggttgcgggggtcgtgtctttgatcacttcaataaatttagggtccataataagtactcctttacgagttttatattctcataatatattgtaattgatatatataaattatcaaccgagagtgttcgatgtctcagtaatcttagcggaggtagcatggtaaaaccaggcgttgctttttactaatgaaagcggtaactttagctaggaacgaataacgagagggtgtttgatatgtatcaagcaagccagaagcgctatgaccatatgatttataatcgagtaggcaatagtggtttgaagctgtcagcaatcgggctaggtctttggaataattttggaagcgttgatccgatcgctaatcaaagggcaatcattcatcaagcttttgatttgggaattacctactacgacttagccaataactatggcccggagcccggcagtgcagaaactaattttggtcgtattatggctaccgatatgcggccataccgtgacgaaatggtcattgctagtaaagcgggctatgtgatgtggccgggaccatacggcaattgggggtcacgaaaaaagtattattgccagtgctgatcagagtctgcagcgaactggtttagactactttgatatttttatagtcaccgtcctgatcctgaaacaccaatggaggagacggccactgcgcttgatcagctagtacggcggggtaagacattgtatgtaggcatttcaaattataatggcaagcagacggctgctatgaccaagatatttgaatcattaggaaccccatacattattcaccaaccacgctataatatgcttaatcgacaggtggaacaggacttgttccccgttctacaagcaactcataaggcggcggttggctttagctcactatcacaggggttattgacagacaagtatctgcacggaatcacgacagattcacgggccaataagcaaacaattccatttttgagtccagtccaggtagaacagacactagctacggtaaagcgcttaaatgaagtcgcgcaacaacgggagcaaagcttagctcaaagtggctttggcttggaacctacgtcagccagccttagcaagtgtcttgattggtgctagccggccagagcggtggtcaataacgttgctgcattggaaaagttgaaatttagtgaatcagaattagcaacgattgaacagattcttaccgaacaaccggcaattgattggaatgctggtcgttcatagcgtttgcacaattcgctatagtcaatgttatagagccgcaaaagaaagaggctgtgacataactagcctctgtataagcaaatgggacgagaaaccgaattttggtttctcgtcccatttgcttacgcctttgatttttaaagttggtccctaccgtgaccaatttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgacccagtttctggagctgaaagtaattctcgttgtttcgatttgaaatattcccaattttcgttcacggaaatccttttaagatatccttttggtgttagtgccgcggcaattagttgatgattttcatcatacttttcggcaatgtattctttaaagtcacgggtaaaaccatacttatcagtccgttgacgataagcattaaaattaaaccggacgttttgcggattgataaaataatcatctttttcatgatagtcccagttcataaccttacggtcatcactttgccattttcgactattctctttaagcattgtgccgtagggaatcaaaacggtatgctgaccgaattcatcttccaagtaccgataattactttcggaaccgtatccggcatcggcaacgatggtgtgacctaacacattgttggcctttaaatgttcaataaacggttgtaaggttcgtgtgtcggttggattttggaaaagccgatatcccgtaaatgaactgattactcgtggcgatttgaacgttgtaggcgggttttaattgaccgttttgcatcggatcttccttgacccgcataaaggtggcatcgtgatccgtcttagagtagctgttacgctgaccatagattgcttgctgtgcttggtgttcacgcattttatcacgtcgtttatccaacttacgtttttgtgatttaacagtccggcgttgctgtttggctgggttcgggaaacccgcttagttgcttccacggtttcattaaggaccactaagtgatcctcaaccttgctaatcatgatatccaatagttcgggagtcagctctgatcccgccggaatttcaccgacaattttagcttcatgaagctcgcctaacagatcaacgagtttttcgcgattcatcttgtcaaatcgtatcgtattcttcttccaaacaaagctatacttgttggcgtcggctaggatcttagttccatcaataaatgaaacatcatccaatcatgccattttgacgaagatattgggttagctgtgataagctatcggttgtcaaagtggccagttcatcagaaattctaaagcgacaaatcgtccggtaggacggaatttggtcggcaattaaccacccagctggcttgttttcacgggcaaactgttcaattttacgactgctgaaaatgccatagcagtatgctaaaaggaccagttttaacatggcaccgaggttatattcccgcggacggccaaactggtaatcatattttagttttaaactctcaacaagttggttgatgtaacgagcaggatgatgctcttctggttggtaatccaaggcgatactcaaagtggtttgattcatgttataataatcttgcatattaggaatgtcctttcgaggataatttcgtagagtatcgggtgcgaccgatgctcttttttattttctattatatcaaaaacaggtctggaaaaatccgaagatttttccagacctgttttgtttctagagacttatgtcacagcctctttctgtacctaatagttaagttaataataacataattttgcagatttgcacgcacagggggcctttactaaataaattagtgtttaaattcgccaattttcacaattaatgataaagttttacatgatagttatcacgattatgcgttgaagttcggcgcaatacttgaaaattaaaataatttgcaaataaatcatgcgatagcgactttagatggtagtaagaattagtttgaatttaagggggccaattcatggcggcgacgctaaaagatattgcaaataaagttggcgtatcattggcaacggtatcgcgcgtgttaaacaaagatcagtcattgtctgttagtgatacaacgcgccaacgaattctagatgcagcagaagcattacagtattcaaaaaataaacggcatactgtcacgacggcgcgtaagcgacttgctattgttcaatggtattcggaactctctaaggaacaagatgatttgtattatatgtcggtccggatggggattgaacgtcgtggacaggataatcagtttgaagtgactcggattttccaaaataatttacaagaattgggaccagacgtagatgcagtgattgcagttggaaagttcagcgagccacaagtcaaggacttggcatcagtaactgacaacttagtattcgtagatgatgatcagtttgatgctggttttgatagtgtcattactgattttcggttggccacagaaaaagttgtcgattatttttggcaacgcaactttcatcatattggctttattcacggtcaagaaatgacaaccgaccatcagttagcggtagttgatcgacgcatgctaggttttcgggccgcgatggaacgacggcatgcgtttgatcctaagttcgtttttaagggcgattatactagtgaatctgggtttaaaatgatgcaaaaagccattcgtaagttgggagaccatgctaccaggagccttctttgtggcaaatgatccgatggcggcgggtgcgcttaaagcgttgcaagctagtggcatccaggtgccagaacgagtgaagctatttagctttaacaatacttcgctggcgacattcgtttatcccgaattaagcgcagttaacgtagatactgagttaatgggggcgaccgcagttaatttggtcatcagtcgactagcggggcgaacaacgacacaacgggttgagctgggtactaatctggttgagcgagcaagttccaagtagtgaagggcgatctgggatagaaaccagatcgttcttttagcattttaactaaaagttttactcaacttcaagaaattctggtatacttctaaatgaaagcggtttaaataacgcggaggtgcatgattttggaaactaaaaaaacggtgtttgaccaactagatggtcaagatgtaatgcgttatacgctggtcaatgaccatcaaactcgtatctccggtccttagttatggtgggacgtggcaagaattcgtcgtcaatgaagacggcgttgaacatcccttgatttggggccttgataacatgactgactatcaacgagtgggatactgcctatgtcaatcaattggtcgggttgctggccggattggcggcgctaagttcaaaatcgatgatcaatcctatcaagttgatatgaacgaacaaacccattcgctacacggcgggaatcatggttttaacacgctgaactttgaaggtgcttttagccaaaccaatgatagtgtcagtgtgactttgaagaagcatatcaacgccagtgatgataattacccgggaaatatggatgtcgctatcaagtttacattagataatcaggatcaagtatccattgcatttaccggtgatactgatgcagcaaccctctttaatccaactaatcacgtttattggaacacaactgatgatcggaccagtttggcccaacaaaaattacagattacgagtgcagctcacttggaatttgatgatgaaaaagtcccaactggtaagaaattagcagttaaaggcacagcgtatgactttaaccaggcacaaccagttgaaaaggcattagaccagctgaagactgagaatggtggcattgaatttgacgatgcgtatgaagttgccccaagtgcggcagaaccaattgctatcgttggggatactgatgataagcgccaagtaaaaatttattcagatcgcaatagtcttattatcttcacggctaatccgtttgatgctgataaggaagacgcgcatcaatataatgcgttagcgacggaagcccagacacttcctgatgcaatcaatcatcctgattttggtgatattgtgttacgtccaggagcaccagtgacgcatacgattcggtaccaatatgaacggttaaattaatactagttgaggtgtcaggcgagttctgcctggcgcctttttgtaaacgtatgaggtaaacaatgtttaatttagttaacaaagtcccgagcatctgattaataccgtgattagtaaaacgatgatcattggtaagataatgagtactatactgcttaagcccttggaaagcgggcaatcagtgtcgataggcgcattagcgaggtcctaatcaaaagcggtatagataaaacttttgaacaaattttactaaaaatcattgacattacttctgaaaacgattacatttaaacttgtaaattattcaaggaagatgtgaggcgagattatggatgcagagacaaagcagagtaaaggtcgtaaaataacatcgcgacttgcttattcgtttggggcgtttgggcacgatgccttctatgccactttatcaacttattttattatgtttgtgacctcccacttgttcgataagagtagtggggctcaaggaacacaaatgattgcttggatcaccatgattattgcgggtttgcggttcgtggaactagcaattgatcctttgatcgggaatgccattgataatacggtagattgtaaaattaatccgaacgctgttcggacaaaaagatcagcttcctttaaaatggtgtttaccacaaacccatttttaggagctgatcttttgtctagtataacctattctgaacgaattaaaattgaaaccttttgtgagctaggactgaccaatatccaaatggctgagcggttaaaacgatctccgtctacgatttcttatgaattatctcgttgtcaaccttatcaagctgaattagcacaggccaacgctgaatataaacgggcgcattgtggccgaaaaactaaactgaatgccaaattaaagcaaaccattctaaaccatttacgtctaagctggtcaccagaagtgattgcgcatgagcttaaactagccactaaatctatttataattggctatatcaggggaaaattgaattctccttaagtgaattacctgaacatgggctacgccaacggcgtaaccttgaccaacgttctaaatataatcaatcattagggcgttcaattgaacaacgaccaattgtgattaaccaacgtaaccgcatcggtgattttgaaatagatacagtggttggccctcgtggacatagcaaggctgctttattaacgctaattgatcgcaaatcacgttttctttgggcttaccgattaaaagatcggacagcggcgactgttaatgaagccctaactaagtttctagcaacttttaagggaccagtacacagctttactgttgatcatggcactgagtttagcaagttagtattatttgaaccacaatacggtattccgacctattactgccatgctttacacgcccgctgaacgcggcagtaatgaacggttcaatcggagcttacgttatttttaccctaaggggacttattttgagcacattagtgctcaagatttaacaacgacgttactcgaaattaaccagcgtccccttaaagttacttacctggcaaacaccttaccaagtgatgctgactaatttgtcaaaaattcggattaaatttgcaatctaccatactaattctcggtggggccactttaaaccatggattgtcattggtgggattataggttccgtcgttttagcacttttattcacgagtttaggcggattaaatacctcaaaccccattctatatttaattatttttgcaattttatacattacaatggatattttctattcgtttaaagatgttggtttttggtcaatgattccagcaatctcatttgactcagcagaacgtgaaaagacggcgacatacgcccgggttggctctaacattggtgccaacatcgttggggttatcgttatgccaatcgtcttaatgttttctgttaagtctaacagtggtcaaggtgacaaccgtggttggatggcatttgggatcattattgccgcaatcgctttgatttctgccttagttgttgcacttggaaaccaaagaaaatgattctgaattgcgtaagaacactgaaaagactagcttcaaggaagtcttcaaagtgttagcccgtaacgatcaattgatgtggttatcattgatgtatgggatctacacggcggggattgccattacgaactcactagaactttactacttcacctatattttgggtgacgcctcgaagtttacactattaggttcgctaaatgcgattattgggatttttgccgtattggccttcccaccattagcaaagaagtttagtcgtcgtaaagtgttcttcttagcagttgttattatgatgatttcactgatcatgtttgcctttgctggtcagtcattaccaatgatcttaacagcggccgtattattctacattccacaaccattaattttcttagttgttttgatggttttgagtgattctgttgaatatgggcagttgaagtttggtcatcgtgacgaatctttaaccttatccgttcggccttttacttgataaattaggcggtgcgatttctaacggtgtcgttggtttaactgctgtttgggctgggatgacagctggtgccactgctggtgatgtgactagccatggcgctgccatcttcaagttaatgatgttcggtgtactgctgctatgattttgattgggacattcatcttcttcaagaaggttaagttggatgaaaagatgcatgcacaaatcgttgatgaacttgaaaaacatggtcaactcacttgaaaccgatgaaactcccgctgaagttgaagcagaagccgatgccaagacgacggtttatcaagatcctgttgccggggaactgatcagtttgaaagatgttgctgacgaatccttcgcaaacggtagtatgggtaaaggtttcgccattaaaccaacggatggtcgcgttgtcgcaccatttgatggtgaagttgttgcaaccttcccgactcgccatgcaatcggattacgttctgatacccggtattttaacgctaattcatattgggattggtaccgttaagatgcgtgggactggatttgttcagtacgttgagaagggcgaccatgtcacacaagggcaagaattaattgaattctggcaaccagcaattgaaaaggctggcttggatgataccgttatggtcgttattacaaactataaagatatgcccgaatttacgtatcttaaagattcaggaaccaccgtacaagatgatgaagatgtcttacaattatcgaatgtcggcttaccggatcaagcatagtttctttacgaggagagctattaatgacgcgagccattaatagctctttttgtgaactgaaatagaaaaagctaatagcgaagggaagattttactatggcagtaacgttgcagcaaactttaattgacattgatgaagaacaacttgtctttcacccgcataacgatcaaatctcgtatattctaggtgtggagacaggcaacgtgttggcccccacttgtactttggcccacgggttcggggttatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaagactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgggatcggccagttatcacgcgtagcgcccggttgattaatcacagtgagcaagctgtcgacttagaaaaagtggcttcgatgcagatggacccgccaacccaaccattagatgccatttcgttacctgggaaagctatgcgcgtgagcgccagcttagtcgcgaacggctccatcgaggtgtaactcagtttgaaagtcgccggggtgctagttctcatcatatgaatccttttgtggcgctagctgatccgaatactaatgaatttcaaggcaatgtccttggtgcattgctaatttattcaggtaaccaccagattagtttagaacgggacccaattggtcagacacgcttgactatgggaatcaatgaatataacttcgactggcgattggcggccggtgatagtttccaaacgcccgaggttgcaatggtatactcgacgacggggcttaatggtatgtcgcaaacctaccatgatttattgcgtgatcgcgtggcgcgcagtcgttacaagcacgatctccggccgatcttgatcaacaattgggaagccacttactttgactttgatgcggacaagattcaatcaatcttggatgctgcagcaccactgggtatcgaaatgtttgtgctggatgacggttggttcggtcatcgaaatgatgataatagttcgctaggtgactggtttgttaatcggaacaagttaccaggaggcttagcggatattagcaaacggacccatgataaagggatgcggttcggactttggttcgagccagaaaatatttcagccgattccgatctttatcgggcccatcctgattgggtgttaggcgtaccagatcgtggccgaacgttatcgcggaacgaatacgtgcttgatttcagccagccggatgttgtcgacaatatttttgaacaaatgaccgcagttcttgataaggtgcccattgattatatcaagtgggatatgaaccgcaatttaacggaagtctattcgccacatagcgattcaactcatgaaggtgagactagccaccgctttatcttaggtgtatatgacttgatggagcgtttaacaaaacgctatccacagatcttatttgaaggctgctctggcggtggtggtggccgctttgatgctggtttaatgtattatatgccacagagttggccatcagataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcgggccgttaaaagacaggttgccttctataagcagcaccgtgagttagttcaatacgggaccttttatcgattagagagcccgtttgaatctaatacggtggcgtggatgtttgttagtccggatcagaaagaagccttgctgttcaccttcgttattttaggtgcagttcaaccagaaccgcatattacgaagttagcgggattagaccctcagcagacctacgttgagaccgacacaaaacccaaaatgtacggtggcgatgaattgatgcaactaggactctacacgactcccgttcaaactagtgactttacggcgcggtacattacttcaaggctaaggactaagctcagccattaaacatattaaaacttaatcatcgttaatctaaaagaacgctctggcaaataactcgccggagcgttcttttgaaatcaaaataacttttagaaatgaatattaaagctgaagtcaatgtcttgatcagcggggatatgatatggggattctacgtctgttccccaactatcaatgccaccgaccccacgaacggcaccgtagattgataagaccgttcgccgtgctaatggtaattcttccatgtgcgttgcgttttctagttcagcggcggtatagggaaggcagctgaaggcgaatggtgcatcggcttggctaaatgtcaaactgaacggtgtgttgtcgtggtcagcgttattttgtgttgttgatcgcgttactgtcagcttgttcagtttgcatgtgcatgccgcattcttgtgggaccaagtatggtgtgactggcagactgtcaacgtggaattgtccgtgcgttgcgccagccagccggtcaggataagtctcaccggacaaaccggtatagtcgaagccggtcgcggtagttggcatgataaaccgcagaccaaatgcgggtagctctggcaaatcagactgaccgctataatgggtggcgatattgatctgaccgtctgccgtcaccgtataagtcactgtgacgatggtactaggaacggtcgtggtaacgaagtggtaagccagtgagactttcgtggcgttttcgtgatccgtgtatttgttattgagtggcgcgattggtaacggtgtgactggttggtcgtcaaccgtcaattcgatatcttgacaagttgagaacttatcggccgcgtaccactgtgcggatttgactgaaaagccgctaccgtgatcattatcggttgtcgccccgccgccaaaagatgggcgtgggtgtacgatagagccactctttatcgttgacgacgagtgattcaagtccgccacgttcgtagctaaagaggtagtggaaattagccccctgtagtcctaaactcccgtcgccgtaaataacgtgtagttgattatttgtgtaagccataataatatttcacctcttgcattgctggttttggtgtccggtcggcaaacattaagccgtcaccggagaattcataatcggagtggcgttcgtcgaaatcaccgccataccggagcacgtcttggtcggtaattgggtcatgaacgaagagggcttgatcaataaagtcccaaataaagccaccttgatacatcggatacttgtcgatcaaatcattatatgattgcataccgcccagagaattccccatgtcatgcatatattcacaatctaggaaaggtttggttgggttatcttccaagtaagctacaatattttggggcttttcgtacatccgactttcaacatcagaaatgcgatcttttaattctggtgtgtggacaacaccttcgtagtggacgagtcgtgaatcatcgtgttctttataaaaagccgcatcgccgcgatatcttcgccagcatacgattcattgccaagtgaccaaaaaatgatcgatgggtggtttttaaaccattcgtagttcgaacgggcccggtcgatcaccgctgctaaccagtgtggattatcgccaggaacattgtaagaaggctcgatagcacccatcttttgccatgacccgtgcgattcgaggttgttttcggccattaggtagataccggcctcgtcacataattgataccaaggtaattgatcaggataatgggtccgatcggcattgatattgttagctaacatggtttggatatcagcgcgcatatcatccatactgataacgcgaccggtgtgggcgttccattcgtgccggttaaccccgttgatcaccaaccgtttttattattgttgacgtaaatgactttgtcatcgcgcagctcgaccgtccggaacccaaactgatatgggacgacttccaagagttggcgatcagcatcgtaaacttcaattgtcaattgatagagatacggcgtttgtggtgaccacaagtgcagttggtcgaataacatggtatcaaaggttacactgccactaccggtttgcgtttgactcgtcagtactcgcccgtcatggtctttaacggtcagcgctaaagtggctggttcaccggttactttagtagtgatgttgagctcaccacttttgagattggcatttggaactggtcggatgtccaaatcagtaatatggctagcaggctccgccagtatattgacgtcacggaaaataccagagaaacggaacatatcttggtcttcaataaaggcagcagtactgcgtttgtagacccgaaccgctaaaacgttaccttggtcctgaatatacggcgtcaaatcaaattctttgaaggggtgaaactatcttcagcgtagccaataaaatggccatttaaccagacgtacagggcttcttctaccccttggaactgaatgataatacgttgccctttaaaagcatcgtcgagatcaaaggttttgaggtacgagccgacggtgttgtccgcagcgtcgctgaataggcctggtgttaattgatcttgattgagggtatacggtgggcgacgataaattttaccttcccatgggtatagcgtgttaatgtattgaatttgaccatagccggctagttcaatatgaccgggaacttgaatcgtatcaaagtcggttgcatcgaaatcgggttgataaaaatcaactgggcgttcagccggtgtcttggcgaagttaaaacgccaagcgccattgagactcttgatgaagcgactacccgttttgaattctgctgtgtcgtgataataatggtgatcactatatgcgggtaattggttgacccggaagactttactgggtcatctaaccattgaagattagcttgcatgaggaagctcctttcaaagttacataaataaaaacgcttacaattatcataaaacaaaatattaaatttgtatatgtcgttttagttaaactttaactaaatgacaacaactactgacaacgacaacgggcgataagaagaatttgaatcgataacgtgataaatttgtaaagcgttaccaaatcttgttctaaaggtcttatggggtgttgacaacaatcaaaaaaaagcattatagtcaaactaataaaattttagtaaaactatttacggaggggtttttcatgaatactagcgacttaaaacaggagtttaccgaagcctttgataccaagccagaacgggtctttttctcacctggtcgaatcaacttgatcggtgaacatactgattataacgggggccatgttttcccatgtgcgattacaatcgggacatatggtgtttatgcaccccggacagatacgacagtgcggatgtactcagctaatattccagatgctgggatcgtcacgtttgatgtcaacgacctttcatatgacaaagccgctggttggacaaattatcctaagggaatgatggacgaaatcgcgaagaccggcgttaaattcgatcatggttttgatttctacgtccatggcaacatgcctgatggtgctggattatcatcatctgcgtcaattgagttattaactggaatcatgttaaacactggttttaatctcggtattagccaattagatcttgttaagattggtcaaaagtgcgaaaacaactatgttggtgttaactccgggatcatggatcaatttgctgttggaatgggtaaaaaggaccaagcaattttacttgataccaacaccatggactattcttatgcacccgtaaagttaggcaacaacgtaatcgttatcatgaatacgaacaaacggcgcgaattggcggattcaaaatataatgaacgcccagctccgaatgtgaagaagcattacgccgattacaaactaagttagacatcaaatcacttggcgatttaactaacgaccagtttgacgaagcggcctacttaatcaatgatgaaaccttaatcaaacgtgcccggcatgccgttttcgaaaatcaacgggccattcgcgcaactaaggccttggctgacgatgatttaacgacctttggcgaattagtgacggcttcccacgtttcactacactttgactatgaagtgactgggaaagaattggatacgttggccgaaacagcttgaaacaaccaggcgtgcttggtgcgcggatgactggtgctggctttggtggctgtggtattgccatcgttgataaggaccaagtcgatgcctttaaggaaaacgtcggtaaagtttatcgcgacacgattggttacgacgctgatttctacattgctgaaatcgcagacggccctaaggaactttaataaaagaattgatttaaaaatacaaattagcagtaagcattgagaaatattgaggaggaattagaatggcagttttagttttaggtggtgccggctacatcggttcacacgcagttgatcggttggttgcaaaggggtatgacgtggcggttgttgataacttggtcacggggcaccgggcagcggtcaatgaacacgcgcgtttttatgaaggtgatgtccgggatacggcgttcatgaataccgtgtttgaccaagaaaacgttgaaggtgtcattcattttgcagctttctcagttgttcctgaatcgatgaaagatccgctcaagtactttgataacaacacggcggggatggttaagttgctcgaagtgatggctaagcacgatgtgaagaaaatcgtcttctcatcgaccgcagcaacttatggtgaacctaagcgggtgccaatcaaggaatcggacccacaagtgccaactaacccatacggtgaaagtaaattagcgatggaaaagatcatgcactggtcagatgtggcttacgggattaaattcgtggccttacgttactttaacgtggcgggggctaagcctgacggcagcatcggcgaagatcacgcaccagaaacgcatctcgtcccaattattttacaagtagctgctggtgaacgggatcaattacaaatcttcggtgacgactatccaactccagacgggaccaatgttcgggactatgttcacgttgtcgatttagctgatgcacatatcttagccttggaatacctaaagcgggggcacgatagcgatgcgtttaacttgggttcttcaacgggcttctccaacaaacaaatgttggacgctgctcgtgaagtcactggtaagccaattccagcagtcatggcaccacgccgcgctggtgatccaagcacattggttgcagctagcgacaaggcacgtactgttttaggttggacacctcagtatgatgatgtgaaagaaattatcaagacggcttggaacttggaaagaaagtcatccggccggctatgatgatcggggaggccaagcataatgacgagtttggatcaatttgtcacggcggtgatcgcgtcgccttcgcaatatactgaattagatcgaatctatgtgcataaccgggttcttggtttggtcggcgagggtgatccgattgcggcaagcgatgaccaattaacaagtttaaccgatgccttggttaaaacggcgattcaaaatggcaagatcgaagcgacccaatcggatgaagatatcttagcggatcaattgatggatcttgtgaccccgttaccatccgtattaaaccaacgtttttgggataagtatcaggttagtccgcaaacggcaaccgactatttctttaacttaagcaaagctaatgattatatcaagacgcgggccattgcgaaaaacgtggtctttccagcaaaaacgccatttggtgacttagagattaccatcaacttatcaaagcctgaaaaaggatcctaaagcgattgcggcagcgcgtaaccaaccgcaagatggctatccactttgccaactatgtatgcagaatgaaggctatctaggccggctcggttacccagcacggagcaatcaccgaattattcggttaacacttggtggcaatacttggggtttccaatattctccatatgcttactttaatgaacactcgattttcttggatcaagagcaccggccaatggtcattaaccggcaaacttttaccaacttacttgaaattgttcagcaatttccacattactttgtgggcagtaatgcggacttgccaattgttggtggttcaatgctgtcacacgagcattaccaaggtggtcggcacgaatttccaatgatgaaagcgccaattgcacgcacgattgacttaggtatcgcgggtgttaaggctgggattgttaaatggccaatgtcgacgattcggctgacgagtcaggacttggttgcattaacggatgccgctgtgaagattcatgagacgtggaagaattattcggacgagagtgtggatgttcgtgcttatacggatggcacacgtcatcacacaacgacaccgattgcacgcaaagttggcgatgactacgtattagatatcgttttgcgtgataatcagacgtctgctgaatttccagatggcatcttccatccacatcaggatgttcaacatatcaagaaggaaaatattggcttgattgaagtgatgggccgggccattttaccagcccggttgaagaccgaattagctgaagtcggcaaatacttgttggatcagcctaatcaaatggtcgcgatgcatcaagcatgggctgatcaattgaaggccactaataccatcaccgctgacaatgtgacgactgtcattgatacggcggtcggcaacgtctttgcccgggttctggccgatgctggggtctttaagtgggatgacgctggtgaggcagcctttgatcgttttttggtcgcagcaatgcacgattaagttgttaatcaaatgaagacgtggggcaacggggtgttgcagacgcgatttaccgactagtcatgattggtgaatagtgtcacgcccagttgccccacgtttgttattcagtgctaattaagagaaaagaggaatgacgatggccgtaacgttaaaagatattgcgcaacgagcagatgtctcattggcgacggtatcgcgggtcttaaattatgacaagacactatcagtgagcgagcagacacgcaagcgcgtgtttacgattgctggcgagctgcggtacagtaagcgtaaacgtcagcatataaaggcgctaatgcggaaaaatatcgctgtgattcagtggtactctaagattcaagaacatgatgacttatattatttagcgattcgtaaaggaattgagcatcaagctcaagtgtgtggttttacgacgactagtatcttccagaataatttagatcaggttggcgatgatgataattgatgcaatcgtggcggtgggaaaatttagccctgtccaagtacaacagttgagtcgtttgtcaagccagcttgtttttgttgatgacgatcactttgctcagggattcagcagtgtggtgactgattttacgtttgctactaaccgcgtcgttgattatttttggcggcgtggtatccgagatatcggcatgatttatggcaaagagtggtccactgatcagcggtggagattcccaatcaacgtcagcaaagctttgaacaggcgttgcagcggcatcatgcctatcatgctgagtatgtattagctggtgattacactagtcaatctggttatctgatgatgaaacgggccattgaaatgttaggtgaccgcttaccacacgctttctttatcgctaatgatccgatggcagccggtgcgctcaaagcgttacagcaagctgatattgctgtgccacagcgggtcaagttgtttagtttcaataacacgacgcttggccgaatatgtgtatccagagattagctcggtcaatgttgagactgaactgatgggaaagacggccatcgatttgttggtgagccgattccaagatgatcgtcaagcagcccagcgcattgaactgggaacgacgttggtagaacgtgaaagcaccaaatgaaatcatcgagtgttcgtgaaatttggcagaaatatcgtaattaattaatgtgccacccgattgttaaaaagtggtgcatgactttgatggggtactggttggtattgaatagcgcgcgtgaatgggttgagtggtcatgctactgctttctgattagttggtctgttttgctaaggtgtgaggccataataacgacaattgtacccttcaagggtataattgtgagtgaggtgatgaaaatgaaaacaactgccacaatccttaaggagattcggcaacattaccaaattagtcaggcaaagctggcaaagttactcaacacctcggttagaactggtgcagcactgggaacaagcggactaccaaccaagtggcaccgcggtacgtttgattcagattttggctacggacgatgcggtgtataccgcactgacaaacctcgaggaggagaatacgattatgtatttagaacacgatgatcagaagttcaccatcatgggtgtgcagtttcggaatcaagaggaataccgggcgaccatgaatgcaattatcagcaatatgtatgagggttttgagccgactaaggaagatgttcaagacgctcgtcgtttctatgacgaaggcccgattagcgcacaagagatgctagcaagaatacgtacttcgaccaatcgtaaagccgaatgagaaaggtatgggcggactacctacaaccaaacggtattttgaaaaatcgcttaggcattactgaagcggctactttgcagaaaagtgagtacgcaacggcaacagcaattatcccgcaatcactatcttctgccagactctcatcaattgacaggacgtcaaattggagagctaaaattgatcaatgggtttttgctcggtgaaatttacgactgggccggtcactatcgcgaagttgatttcaacaagactgcgaatggcgtggtgacgtttttccacccggtggctttatttggtaatgctgagatggatattcaacgccaactcgataattttgcgatgttaccgaatgatcgggaacagcttgcacaggcgttgggacaagttgtcaccgaaatcaacatgtttcatccgtttcgggaaggtaatggccgcacgacgcggctgtttactgaggttttggcttggcagcatggttttgacatcaactatacccaggcacagcaggatgcttacatgcaagcgtcaattcaagatgatgctgagatgatggcacaggtgttcctggaagtactaaccaaatagatcaattattgttagtcgtgatactaagaatggtcttaaattaaaacaacaagtgcactcgggaaatttctaatctgagtgcacttgttgttttagtttagtgagatatatgacgtttgtcgcagcggtcaattttactgcttgagtgggccactaacttttcgtttatattcggatggggtggtctttaggtatttttaaacagacgaaagagtgatgaggtgttttgatatccgatgatgtcgcaaatgtcagcgagtgtacagttagttttgatcatcagattttgggcagcagaaattcggcggcggtcaacaagttctttaaaggtcttgcccgtcgcttcttttaatttgttacccagataattcgtattataagagaacttggcgctgacatcacgtaatgtcacgctggcgaaattctgattgatgtactgaatgattggcaaaagattgtcgtccgtattgtcagaaaagttaatgtattcttgctcaatcgattgcgataattcaagaattaatgtagatagcagcagcccattgatttattacgttggcggctctttgtaaggcccttgataattaaactttcaactaaattgatggcaacttcttggtgtgttaagtcaaacagaataaagttgttgtgcaacgtattgatgtgggatgcattatataaaaattgagtgatttcattggttgaaacggcaatatagtcgaaaagttggttcatcgttgagtcattcttgagcaagatgttaatcaaaatatcattactgcccgttgattcaatttgctgaacaatgtctttatccatcaaaattaggttgtgctgatggagggtcactttttcgccattaatatactgagtacaagtgccagcatacatataattaagctcaataaagctatgcgtgtgagctggaacataggaaaagcgattatttttggtaacagcaatatcaccgtgcttaaaaaaatctgagcggggcatctggggaatcggattattcacatagtctaagtccatgtagttaacgttaccatgtgattggcgttgctttagctcaaccggtgtcagagcaaataattcgtaattgagaaatttactagtcattaatactaaccttctttaatatttatcgtttagtacaacctgtgattttgcacgatcattcatgtagttgagatatggtaccccttacagtaatcgcttacaatattcgtataaataaagggaggttcttcatatgaataacggcgagacgtcaacttcaatggtgaaaaatatcggccattagcagtagctgcgggaattggttccattctaggatcaggaattatcgttggcttatccgcgactattacagtgtggcagaacggactaggtcttactaacagtcaagttggtattatttcaggtgcactaacttttgcaattgcaattggatccttattagcgggacagataacaaaatcttttggtctagttaaatcgtttaattggttaaacctgatttatgcgattggcgccttgatctgtgttttctcgaataattatatcatgcttttgattggcgtcatcattaccgggttagcttcgggtgctgatttaccaattagtttaaccgtagtttcgcatgatgcaccggatgataagacctcggctagtttagtatcgtcgacgcaaatcttctggcaaattggggttttcatgtcttatgtttgtgcctttattgtttctaaaatggccggtgcttccggtgctcggattgttttttcgattttagcaatttttgccttgattacttgggcatggcggactttttcaactaagttccgagcatttcatgaagaaggtgaacaacggcgtattgatcgcgaagcagcttcacagacaacagagaaggtctcgattaagacggtcttcgctggtgccaacaagggacgctttatggcattcttcttcagtattttaatcttctatgtttgctggaatctactggccaatacgttcggacagtttcaaacgtttacgctggttcaagtcacatgcgagtcaaagtttcgcaactggtgctgggatagtcctaaactttatctcgttgttggcaaccatggcttttgcatcagtcgctgggggtaagtatcgtaataagttcttcttagttgggattaccgttcaatttttggcaatgctcggactagcaatgagtagtcattcgttatggccaattgtcatcacgattggctgttacaacattgggaataatattgctggtgaagcgatgtataaagtttggacacaggaagcatttccagttgaagttcgggcatcagttcaaggatttattaatggcttttcacgggtatgttgtggcctatttgccttaattacaccgcgttagttgtgccatcagcaattcgtaacacgatgtttgggttcgctgccattgtctttattagctttgtagcggggctgacaatgatgcgattggaaaagaaacatggtattaataacttttaaacaaagtatttagaaagcgagagtggaagagatggcgtttacttttcaaatcaataatgatgttcaatttcggcataatcaagcattattagacaagtcggcaagctatcggccaatactgaaagaaacccaagttaaggcggcatcgattgtggcgctcgagcgtgatacgcaataccttgaaggatggggtgttaaacaaattgcacctattgaacgattatcaagttatgagttgaaacgtgacgaccaaattatcatagattttggcgatcatcaggttggtcaatttagtattaatattaacgctgttggttcaccaatggatgcaccactatgttttaagattaagtttgctgaaatgcccgcagaattagcacgcaagagtgaagattacgacggttggttgagcaaatcttggattcaagaagaaactgttcacttagatgtgctgccaaccacgctgacgttaccacgacgctatagttttcgttatgctgagatcacagttgttgataacgtcaccaaaatggcgagctgtttttagcaatccagtggtcacggcgacaagtgcggtagacactgcgacagtgcatcaaccgaaattagccgatgcacaattacaacggatttatgaggttggcttgaaaacattagctgattgtatgcgggatgtctttgaagatggaccaaagcgcgatcggcgattatggattggtgatcttcggctacaagcattggccaattatgcaacgttcaaagatacagatctggtcaagcggtgtctgtatttgttcggtgcgatgcctacaacggctggccggattcccgccaatgtttttactaaaccaacggcagttccagatgacaccttcttgtttgattacagtctattctttatttcaattttggctgattatgaggcgtttagttctgataaaacagttttgaatgatttatatcgtgttgctaaaaagcaaatggatttggcgttggcacaagttacttctgaaggtaaaattgaaattgactgaagaaaatccggttttcatcgactggtcaaatgattttgacaaagaaacggctgggaggccattattatttatacgctaaaacaatttattacgcttgcggaactggttaatgatacaagcttagagacctatacagcgatactgcgtaaattaaaccagtacgctaaaactcaattgtttgattcgcaatcggggttatttgtctcaggggatcagcgtgaagttaatgtggcaagccaagtgtggatgacactagcacatgttttggatcctgagcaaaccacggcgcttatgcaaacgaccgtcacgaaactgtttccaattactggtattgcaacgccgtatatgtatcaccatattacggaagcattatttgaagcaggattaaagcaagaggccgtccaattaatgaaagattactggggcaaaatgattacgctaggtgcggatacttattgggaagcatttgatcctaatcaaacctgattattcgccgtatgggagtcccattttaaatagttattgtcatgcttggagctgtacaccggtgtacttgattaataagtacctcgtttaggaggagtgtctgcgatggttgacgaaaaagtaaagctgagtaaagcaaacgtactcttaataattgttgctggtctagcttcctatatggatgcagcgttgctcgttagtctgggagtagcgctacctatctggacaaaatatttagcactgaatagctggatggtcggactactaagtactatgctgacggtcgcggttgcaattggttcatttgtgggcggctggctgtcggataaatttggccgggtcgcggtgtttaatgctgatatctttttgtcgcgattggctcgtttattattgcgattgcacaaaatacgacgatattgattattggtgttgtgattgctggtttggcctctggtgctgatttaccaacgtcattggcggttatttcggaacggagatgtctagtaaagtttatggtcgggcaatttcttcaactcagatttttttggacgatgggcattttgttgtcacagtttattggttttataactgctaacagtggtatgggaagcccggcagccttatttggttggattggattagtggcaattattaattggtgcgtgcgggtcttttcaaagtgttttaaacagattgaaacagacttagttgaccatgaacatgtggactgtgcatctaacggtcaatcggttaagaagtatcgattaggtcagctattgcgaacaggtggtttgttagtaccaatgattctactaactgtttttatctattttggaatttgccggccaatacgtgggggtcatttgttaactatttcttagtgactgttgatggccgtacgcaagcctattcgacaatcgtggcattaattgccaatattgtgtgtctgttagttaacctgatctatttaaaggtttcagacactaggtatcgcgctaccgagtgatgtatttaggtattgccgtagcattgctttcctttgtgactgcggggatctttagcgatgactggcagattttcaccgttgtttatattttctactctggtagtacagtattatgtggtgaggccctttataaaatttggagtcagactttctatccagtggatgcacgggcaacgatgacgggcttttcttatggcttagttcgggtgctgaccgctgctttctcgctagtaacgccaacattaatgggatattcgccgcaactattattatggattatggttggatgtacggtgctattcggtgcctgtgcagtgatcattgtcgctattattaagaagaccggtttaaaaggcccaacgatgaaaacggtttctgaataaactgattaatattactaagaattaaaaatgtaagccgggcattgccgggcttatttatttaaaatcaaggaggataatgctcatgtcaaaagaggctgtttggttattggtatcctggtgattttgaaatccacgaagggatgttacaaaattttaaacgtgaagaacgtgggatgggttggcccgcctattggtatattgatgattgcaaccgtaatgttaattttaaacggcactatgatttaaaagaatccacacaatttacagtactcgccaaaggaacgggctatgttgatgttaacggcactaagtatcgcttaaatcatgcgattaattgtgatgcgggtgcgactgatattcaagtgtttgttggtaacgttcagggattgccgacgatttatattgttggtgagattatcaaatctgatagtggttggctagctagcaattttgtcaccacattacccgctggtcacgatattctctacactgaccgtaaccaggatcctaatgtgattgaatatcggacagaaaaagtagtggccaaagcacaacaagcagttgacggtggcgttttatatgattttggtcgcgctgtgaatggaacaatatgtgtcacagtcaaaacgaatgggccagttacgctatgttacggggagtccgaaactgaagcacgggatgttgagatgtgttattacaagcagtcggacgttacagctacaacaaaggttcgtaaacgtgcgtttcgatatgtctttgtgcctcattgtcagttaggtgacattgaattaactgctatgcacgaatatattcctaaaaataatccctccagttttacctctgataataagttgatcaatcaaatttggaatgtagcgacggaaacgttaaacctttgcagtgacttgttctttatcgatgggatcaaacgtgatcggtggatttgggctggtgacgcgtaccaagctaattttatcaatcaatattctttcttcaacgaagatattgataaacggacgttattagcgttgcgtgggcaagatgatattaagcaacatatgaatacaattgtcgactattccatgttgtgggtgattggtgttctaaatcattaaaccagatgacgggtgaccgtgaatttctcaaaattatttaccctaagttagagagtatggtgcaatactttattcaacagacaaatgagcatggttttatttatggtcggaaaaatgactggatctttgtcgattggtcagaaatggataaacagggtaccgtggcggctgaacaaatcttattacttgaagattacaagacaattatgacttgtggtgaggtcttaggcaaagatgtggcgggctaccaagcgaagtatgaccagttgtttaagaacttaatgaaatacttttgggatgatgaacaaggagcatttattgatagttatgaatcgggtaagcggcacgttactcgtcatgctaatatttttgccattttgtttgacgttgttgatgagaacaaacaacaattaattttaaagaatgttttgttgaataatgcgattactcaaattaccacgccgtattttaagttttttgaacaagatgctttatgtaagcctggggaacaacaccgtgtttaccaagttttattagactattggggcggcatgttagatcgcggggccgtgaccttctgggaagaattcgatccgtcgcagcatggcaaggatatgtatgccatgtatggtgatccctatggtaagagcctgtgccatgcctggggagccagtccgatatatttattaggtcgtcattttgtaggattacggcccacggctccaggataccagacttttgagatcaagcctgagttatcagaatttcatcatttacacaccgtgttacccattaaaggcggtaccgtgactgtcgtaaaagatcaacaccaactatcagtcactgctagccgagctggtgggacattgattgtggatgggcaaagacaatctttggaacctaatagaactgcggtggtcccagtgtagccgtcattattttaatgggttaatttagaagacacttttggtatgcgcttgttgaagcaagtgcataccaaaaaagtgtctttgatttgtgtcaaactatgatttattcgtcggcttcacaaaacttttccgataaattaatttagcatcaactaataccatgcgcttctgtgaacggtcaaaaataatcgtatctttcaatgttgtgatagcctgtgcggctaagtcgtctgtgtcaatgtggaaagtcgtcaatggtggtgaaacgtagcgcgcaatgtcgatatcgttaatactaataattgcggtatcagtggggactgtgattttgttttcattgaaagcctgtaagacacccacggccaacggatctgaaccgactaagaaccctttgggcaatgcttgtttactcaacgattgcacgacttgttgtcccaagcgatagccacttgcaacggagaattcaccaccaatgaatagaaaccgcgaatcaaatagttgtaactcgcgtagccgactttcaaagtatttttggcgcggatcttgttgatgggtgacttgttgatctttattccagtagccgccgttaatgagaccaatgggcgtatcacccgcggctatcaattgatcgatggcttgttcggtaattgcttggaggttaggctgtacagaattgaagtgatgcgggtctggattggaatcaacgaagattctgtggggtgttagctggcgcaatttatggagcgcatcagaatcgaattcgccaactgccatcacaccgtcgatgtcgtggggaatgtggtcgatatccggataaaaggtgagctttaaattagcctgttttccgtgttcaacgagactctgacgcaaattactgaaataaatatcttcaagttcttgttttggttggacagcgaagattgtagctacctgataggcaaggccgtgagtggtgtttggttgttcgtaattcaagttttgagcagtttgtagtatttttttgcgagcgtgatccgagattgaaaatgacggatcattattcaacagccgtgagacggttgccggtgtgaatagcccgctttagcggcaatttcacgaatagtcggcacagtggaagactcctttcgacaaacaagttactaaacagatgattaccagagttaaaaagcttcacttataataatacgctttcattagcgctaataaaagcagtaatgaatataaacaaaacgtaaatagtgtttactgatatttagtaattattttagtaaaacgggttacattcgtaaatgaaagcgcttatcataagagctgttaaagcgtaattaagttgatagaagtgagggtgcgtttgaatgtccaatccattaaagacaacagaatttttgcatggtggtgattataatccagaccagtggcttgaccaacccgaggtgattaagcgggattttaaagcgtttaaggctgctaagttaaatacggtgacattgggaatctttgcttgggacaagttagagcccgctgaggggcagtatgattttagctggttagatcaaattttcgatcgtgcccgaagcccaagggactaagatcattttgtcgacgccaagcggggctcgtccacgctggttagctgagaaatatccagaagtgttacgtgtcaatgaacacggacagcgaaatcaattcggcgagcgacataatcactgttacacatcgccagtttaccgagaaaaggttcaaatgattaaccagaagttggcggaacgttacggtcaacgaccaagcttgctgctatggcatatctctaatgaatatggcggtgcttgttactgtgatttgtgccagcaagcctttcgtcattgggttcaaaaaagtatcaaacgttagccaatttgaaccatgcttactgtggtgctttttggagtcacgattatacaagttgggatcaggttcaggcaccgtctccgctgggtgatacgaatgtaatgggacttaacctggattggcatcgttttgtaacagaccggacgattgactttttgataatgaaattaaaccgttacgagcgctgctgacacctaatatccctgtgacagccaattttatgggtggcaacccatcagaatcacacgtcttttatgatttagattatcagaagtttgcgaagcatgtcgatattgtgagttgggattcatatcctaattggagtaatggttacgaaagtacggcccacttggccatgaaaactgctttgatgaatgacgtgatgcggagcctcaagcatgataactacttgattatggaaagtacaccgtcacaggttaattggcacccatataatcgtgccaaacgaccaggcatgcacgaaatggggagcttgcaacaggttgcccatggtgccgactcagttttgtatttccaactacatcaatcattaggagcttctgaaatgtttcatggcgccgtcattgccaaccatcgtggctcaaatacgcgggcatttaaggacgttcaaaaagttggtcaggacttacaaagcttacaggccgcgcatggaacgaccagaactgaccagctaaagtcgctattgtttttgattatgacaacatgtgggggttagatgatgcccgcaactacgctaacgaaactaaaaagtattggcgcacgattcaagaacattaccagtatttctggaaacatgatattccagttgaaattattgcgactactgatgatttgacggcctatgatttggtgattgatccgatgcacttcatgatgagcgcccagtttgcgactaagcttaaagcatatgtgcaacagggcggccatctgatcggcacctatattacgggcgtcgttgatcatgacttcttagcctatcaaggtgatgggttagctgacttagaagcaacttacggaattaaagttcaggaaactgatacattatatccgcaacaacataatgcactgactgcttatcaccaagcgtatcaagtgaatgattattgtgatgtagttgagacgacaacagcacaagtcctcggcacgtatcaaaaagacttttatgctgggaacgccggctgtaacgctcaatcaattgggccagggagcggcgtattatttggctgcgcggaccgatactgacttcttggatgctttctatgaacggcttgccacaagtttggcacttaaaccggccttgccagtgatcaaagcgaatgccaaggtaagtattcaagttagagagaatgcgacgacacgctattacttcgtgatcaattttagtcatcgaccaacgacggtgacacttgaagtgccgttacggcagatttttgagaatcaagtggtcagtggcaagcaagacttggccagctatggtgttcaagtctatatgatgaataaataattaagtggggtgaaattaatggcacaaaatgttgaacaacaaccagtaaccaagaaaaagttatcatggcatcaaattaatgaaggtgttgcctttggattaggtaacttaggacactcggcattctatggtgcgttgagtacctattttattgtctttgtcactagtgggatgtttagcggcgttgcaccagctatcgccaatcggttgattggtttaatcacaggactggtggtggtgattcgtttagcggaagtcgttgtcgatccaatcttaggcaatattgttgataatacggaaacacgttggggtaagtttaagccttggcaagtcattgggagtatcatcagttcggtcttattagtcgttattttctcaggaatctttggattagcaaaggtaaactggattttatttgcaattgtttttgtgattttatttattatcttggatgtcttctattcgttaacagatgtctcgtattggggcatggttccagcgattagtgaagatagtcatgcccggggaattttcacggctcttggcagttttactgggacgatcggttggaacggcctgacaatggtcgttgtaccaattaccacgtactttacctttatcgcaactggtaagcatacccaaggtccacaaggctggctagcgcgttttgccgttattgtcggtattgtggcagtcatttccgcactatttgtcgcctttggaaccagtgagaagcacaatgcgattcgggaagcagccaaacaaaagacgacgatcaaaggtgtctttatgggcattatcaagaatgaccaaattatgtgggtcagtctgggttacttattctattcattagcatacgtgacaaccaacggggttctattctatctttttaaattcgtgattggtaaacctggtgaattttggattgctggggcggtcgcaactgtgatcggttttgtgacgtcaccactatatccaatcttgaaccggtttattccacggaaagtgctctttgcactcggtcaatgctcaatgattttagcctatattatctttattgttgcgcagacgaatttgaccttattgatcatcggattagtccttttcaatattaactttgcccaattagtcacggtcctatcaatgaccgatgccattgaatacgggttcaattgaagaatggcaatcgtaatgaagcggtggtgcttgccgttcggccgatgctcgacaaaattactggtgccttttccaacggtatcgtcggtgccattgctttagttgctggtatgactggtagtgcaacggccgccgatatgactgcaagtaatattcatacgtttgaactcttagcgtcttacttgccgttagcatgtgcaatcttgtcattgttagtctttacattcaaagtaaccattaccgaaaagaaacatgccgaaattgttgaagagttacaggccaaattggcaacaggggaagcagcggatgttgcggtaacgcccgcatctgacattctgaccactgaaatcttagcaccagtaagcggtcaaccgctcgcattagcggatgtcaaaagtgccgcacagccacaaggcttaccgggagttggtttcgccatcaggccaagtgatggtcgcctctatgcgccattcgatgggacgattcggttttacgttctcaactaaacatacgttaggaatcgtgtcagctgacggtcttgaaacaattattcacgtgggaatcgggacggttaacctccgtggtgctggctttacgacttattatcaagatgggcaagtcgtacacgctggtgatttactgatgacctttgatcgtgatctgatcaaacagagtggttatgacgatgtggttgttactttctttacgcaacctggtcgcgttacagcacacactgaagattggtcaacagaagtacagcatggtcaatcagcaatgaaagtaacattcaaatagattggagttgtcggtcatgacaacgccgactcattgcgataattgttcgtgttagacttgaggtatcaaataagcactgatcacaaaatagtgggcagtgcttatttggcattcattaaatttttaacaagtacggtaccggttagcgtttcatcggtacttccatgccagtgctggtctttgcccgctgtaacaatacaagtagtgggccgtgccaaagacggcaccaactagcgcgaggactaaccaatccattccgctgctggcaagtggtaagaagctttggacatgcgccattgcttggccgaaagtactttggctaacaacggcggggaaagcggcaaccatatcaaagacggcggggacgacggtgaagacgacgacccaaacatagacgacacttgacttgtggaagagtggcgaaaggatcgataagaagattagtgccatggctaacgggtaaaggaacatcaggacggggtggaccaggcaatgatctgatttaatcccacattagcagttaaaaatgaggcgaggcacgtgattcttaaccaggctttgtaactcaagaaaccgaagtgcttatggaagtcctgagcgaaggcggcgacgagcccgatagcggtggtcaaacaagtggtaatgatcaacacggctaaaatggcttgtccgacattacccatgtagtggttaacgatgattttggtcaaaggcgaccccgccgttatcggataatttgaattgacctaacgattgcgcgcctaacaagattaagagcacgtaaatcaagccttcaaaggccattgagaagaagccagctcgggcggtcacccacgcggctttgttcgggtcggtttggcccatgaaattaacggcagtgacgatagtgacacctaacgccaacccagctaaggcgtccatcgtgttgtagccttgcaagaaaccattggtaaagctcgcggtctgataggcagcagttgcactggtgctaccggcatgagctagcggactgctgaaagctacggcgaagatggcgactaataatagcaaaaataatggatttaataatttgccgacccgagccataattttgctctgttcaacggacaagtagtaggcgagtccgaaaaatgcggcggaaaacagcagtaatgcgagtgattgatactttgctgggaaaaacggtgccagaccaacggtgtgaatgatacggtggccgtccgtggtgttccaaagaaggggccaattgtaaagtgtatgagaaccatgaagacaacggcaaaggttgcgcctagtggtttaccaatgtcataaacgcccttagatttagtgacacagacggctaaaaccgatagtaagggcaataaaaccgccgtgatgagaaagccggccgcagcaatccccagtgaccgcccgctagctgacccaagtgaagtggaaaaatgaggttgccagccccgaagaataaggcgaaaatcattgaacttaaggtgacgtaatcacgtttggtcaaatttctcttttgaactcgatttaacatatcaacagcactcccttatttgattgagacaataatcattaaataaaagttgcgattaaccaaaaaacgtcctgatatctgagttagactcagaaaccaggacgtttgaacacgtgttaccaccttagctttgtgactgccttacgacgaatcaccttaaaaatggtacggcaagtggccggccacttgcgatacttcggctcaataatgggagcaaccaacagcaactaacatcaagctcgtcactgccactcagaactgattttcaacgatctggtcatgatgtcattgcaccaaactgacactctctaggcatttccagaaggtttactttgttcatcggcgtgtttgttaatcgatttttaatgtggttctaatttacaaccgcgattagtatttgtcaatctttttcaaaaaaaagttagttagctagtgcggattcttaaataaagatggataatagctgtaataaggaaatttgtgaggagggtccgctgatgaccaacaacaatgaggaaaggccccaatggcaagtgaatcagaaccgccatacccgttttcggacgattgtcagtgtcttgcggcgctataacgttttgagcaaccttgcacgtcagaaaaatcctgatcaagtgcgcgcggcgtttgaagaacttggaccgacgtttattaaaattggccagattctttcttcacgtacagatatcgttaagccagaatttgctaacgaattcaagaaattgcaaaataatgtccgggccgatgattttagtgtggtcaagcaaacgatcgagcagcagacagggaagccaatcaatgaaatgtttgcccagtttgacgagcgaccgtttgcatcagcatcaatgggccagacgcaccatgcgacgctgctcaatgggcagaaggtcgtggtgaaggtgcagcatccgggtattgacgccgaggtggccctagatatttcattatttgagcgggcgttacccctattgcgatatattccggaatcttcagttgttgatttgcgtgaaatggttggtgaaatcaaacggtcactattcaatgaattggataccagtattgaggtaaaaatggattacggttttaccgattgaataatgcggacgatattattcgggtaccccgggtttatgcgaagtatagagtacgcaaaaagtgcttgttaaccagtatatgccgggaacgacgattcagcattttatggcgcaaatgcttgcggccgatgaagacggaaatcaccagtatgatgacgaacgccgctatttggcccatgtcttggtgcaaaatttcttgaagcgggtttttgaagatggctttttcacgctgatcctcatccagggaatatcttattgcgggaattgcaaccagatgatattgggtatcacgatacggttcccaagcatggcgggaaaattggcaaacggcagttaccaccataccggttagtttatctggattttggcatgatgggtgagatcagtccagctttgatggcgggaattgctaatgttgtcgtggcagtgacaaccgaagatacccatcaagtcggcaaagcaatcttagcgatttcaaaccgaactggcgtggttgatgaagaagcgttctttagtgagttagcaccatttttaagtcagtattataataatcttcaggactgggcgacattgattttcaaggcttgttgtttgaaatggtcaaggtttgtcgcagtaataatattcaaatgaatccagcggttaccatgttaggtaaggcgtttggaacgatcgaaggtattgtggagacgctcgacccaaccttatcaatgatggacgtggcgcggccatttgcgcgcaagtacatccgcgagaattttaattggcgcaatgaactggaagatggcatgttggctagccttcaaagccacgcgtgatgccccgaagattccgtcacgcttattatcagctctagatacgtttgagaatggtcagacgcgggtcaacttggtctttgcacaccgcaagatgtttattgatcggattgattcgatggtcaataagattgtactatccgttattctggcagcgctgattgttggatcatcactactagttcaaagccatcctgataatagttggattacaaacattggtatttttggctatgtttccagcagttgtcgtcattattggcctattgattggaacgctccattcctggtacacgcattggcgacgcaagtaaaacttggcgtagggttaggttataggggctatgcgtcatgaaaagttggcaacgtagattcgtctaattgagactgcctaaaatataagcatacgaaaaacagcggtaccgtgatgattccaagccataaaatcatcacggtaccgctgttttcttaatcatgcttcagtatcaaattgatcgtggttaatggtacgactgtcaattgctaactagtcttctgatcccataacccgggcacagaatgcggccaagatagcgccgacttctggtgctaagatgtagacccatagatgtgataaggcgctaccaccggcaaaaatagcggggccgattgaacgggcggggttcaaagaaccgcccgttaagttgagagcgacaataatcaagaatgctaaggtcaccccaatggtcaaaccagcaaagtctgcgttaccatggtcattactagtaacgttcagaataaccattaaaaataagaatgtgactagtgcttctacaaagaaggccataccactgccgatttttggaaaatcggtttgaccaagcgatgttgcggataagcctaatgcactgacaaacgacttaactgctgcggaagcaacgatggccccaatgatttgggcgatgatatagccaatggcatcggcggcatcgattcgacggttgattaacatcgcagtcgtaacggcgggattaaagtggccaccagaaataccaccaaaggcataggccgaaacggtaatcgctaacccgaaggctaacccaatagcgaggacgtcacccttagcaatcacaacggttgcagtccctaagaaaactaacataaatgtgccgagaaattcggcgagatacttgcgcatagttgcacactcccttttgaataattgctaacttaacctattttacaatacccgctcgtccagaaaacgacggaatttgtttgatttgtgaatatttctgataagatttttataattatattaatggataagatactggtaaaacgttggtataaaaacgttttatggcagttgtggattgttaaaactataataaataaaaattttatttttgcatagtcactattgatagtggtcagtatgattggtgtgtgacctaacgtgactgtgaacgctaattgacgataatggtggcttctgttttataatggttaggacaagtaagctgatgtttttgaaaacgaattaaatttgtttcacgtggaacagtaaaggaaggtttaattaatggcgttatcatatcaagctctattaacagcagttccggtcgttttaaaagcggggaacgtaccgaacattgtcggtgaagccgggattggaaagtcggccttggtagccgaggttgctaagcggatgggggcgcaattatacacgaccgttgtgagcctgtccgaaaaggggattttagcgatcccagtcccaccactaacgagcgactcatttattcaaacgaagcgctatggccagttggctgacgtacaattcggctatgcacacacgttaattgaaattattcagtatgctgagcagcatcctcagcagccaattttatggtttttagacgaatttaatcgtgggacgcgaggctgttcaaagtgaattgatgaatctggtcttgcaacggacgattaacacattgaaattgccagaacaggtgcaattgatcattgctgaaaatccagatgctagtatgactggattcgaaagtagtacgtatggcgttactgccggcgatgcggccatcaaagatcgtaccgtgcgtctagttatgcgagcagatgcggcagactggcttgcttgggccaaacaagtggatgagcgcatgaaccgaccaaacattcatccactcgtccagcagtttattagtgaagatgtaacgcggcttaatcaggctgatgtccagagctgatttaacagcgacgccacgtgcgtgggcgcgtgtttcggctaatttatatgagattgaaaaacttcctgtgcatcaacaaacggctgtggcactggatatctttcaaggagatgtgggtactgagctagggcttgtattcgagcaattcttggaacaacaagccattcatctgacaccagcgatgatttatgacagtcaaccagtgggggccgtggtgccggcaccgattcttaagcagtttacggcgatgaatgaaattcaaaagcgaacggttttggcaagctgtttggctctaacaactacgtatccgttgacggacgatcagcacgctggtcggttcatgcaactcctacaaacactcagtcaagatggtcagtttgcattggttcaacaaatcggccatgaacgcgacttattaaagcaattatatacagcaaatgttgccaagcaaagtccgtatgtgaccgctttgtatcagtatttacaacaggtcgccagttggtcaaatcagtaagaaagcagtgagtcatcatgattaacaatgccaatgagtacacacgttggcaacaagcgatgttagtgacgccaacagcagacacgatccaggcgggtgcgaccatgattgatcgggccattattgagttactagccaccgatcaattttatggcgagttgctgacccgacttcccagacagttaaatacgacgttaacgacgccgtttatcttagcttggcagaataatcagttggtcttacaatatgcgccaacagtaattgctcgagctttttcacagttttcttacttacaagcggggttaaaacacgtggcactacacattgtctggcaacaccccgttcggtatcgtgatcaggtcaagcagcagccggagttagtgacgttggcgaccgacctggccgttaaccagtatgtcgacggtctgcctaaagatgcggtcagtttaacgactgtccagccgttagtcgatgcccagctaaccgcgacgagcagattctggctgttatttgaaattattacagcagcagtcgcggtcgcaacttcagccgaatggcgcgcccaccgccacttcgcgaaataaggaccagcggcagccagcaaagggtctggcgaccaaaagtcgcaacagttgatcgatgatccaagcggctggtcagcctctgaacagttaacgaatcccaatttggcaactgcccgtttaaaacagttggcgaaagatgcttggcagcaaacaaatgaagctggccgagggttagtggccggcaatgttcgagctcagctcactgtaatgacgcagccggcccagcttgattggcgacaattactagttcggggcctgggtcagattccgagcggtactaaggcctcgcacgcgcgctttaatcgacggcaacccgcgcggatggaaatacccggtcaaattggcgatacgcgcttggacttgcaagtttatgttgataattcaggttctatcagtgatctgatgctgcaacgattactggcacaggtggctactttaacccgattatttgcagcaaccatcaccgttaagccgtttgatgcaatcgtacagcctggtcaaacgtatcaggtgagtttgccacagcagattcgctttacgcgccgtggcggtggtggaaccgtttatcaaagtatttttgatgatttactaacacatcataagacgaatgcgacgaccttggcgctgatcttaacggatggccgtggtgaacggcacgttgagtcacaccgttttacaaatgtgatttggttgttagcgcgggctgaagatcgattgtcgattgagccagcaatcggtcatgtagttaatttgaacttggaggatgaataatatggggacaccacttaatccagatgatatgcaatccttgttaacccatgaccgtcgttatcagcgggccagtgccatcttaacggatcagtggcaacgaatcatagccgatgaagatttggcttagccgacaacagattacgattgacgatttacagtttgctaaggcgttgctagctagtgagacgctgacaagtcaatttgaatttgaccattacgcgggtgtgcaacggttgcgacaacattatggtagtcaattgacgagttcagcacagcactggttagtgcaaaaatatttataagtcaatcgctagttatgacccaaaagtatgactgtgacttatatagatgaaaaaaataaagcaagcttttcccaaagtgttcgtgagaagcttgcttattttatgcgctgattaactgctttaggttcaacgacgtgctagaaaagccatccaggcttgttgctgcgcttgaatatctggctgactgccttgacggagtcgcgtttgaaggccaatgcgggcttctagcagtgcctgagctaatgtcatactggactgattattgataatttgctcgttagcttgacctttgaggatgaccgcagccatgagggtcaggtagtcgtcataaaaccagctgacggcttgctgaacatcagtatcagtagtaccaaattcagcgacggcgttagccattaggtcaccggctggttgttcggatatcgttaaatcgtggctaaagagcatactcaggatagctaaggggcggcaccatcctgctctaagcgttgcattgcttgggtacaacgcattaaagtttgttggtgatagcgctggagtgcacgcggtaaagtgtgtgcttgtccccgatagcgttatataaactttgcttcttgacgccactagttattacgatttcgtccatggaagtatgataatagccttgctgccaaaataagtgcatgatttttcgataacttgatcgtcttgaaatgtctttttagcgggcatgattcgaaccgcctttctggttaaaaataagtgttttaagtataccacagcacacttcattgtttggtaaatgaatattaacgtttgaaattatttgattaggggcttttacctgtttttaaagccgattttaattagttgattgtgttgcactttaaaattgataaaagatttccacattaaatcgattacataattttataaattgaagataatttatgtaatagcttgctgttacaacgatattctaaatatatataggatttcaatatttataattatcaaaatttttaacttatgtgtggtctcatcaaagtctaacgataatataatgttgacggcttgtttagttgaacacgccaactagttggacctaatcggataaatgaaagcagtaggaaagcttgccgttaaactgattacagtagtttatattaaaatatttgtaatcactataatattaaaaatggctcagaagtccgttaaaataggaattttaatcaatagttaaggggcgtcatcaattgacagcgattccaaaaccatgatatattttcgttgctgatagggttactcacaacgattcactattggtactaagcgttaataatgatactaagcttaagtcaatatctggaaaggatgtggtcatattaattggatgggcagctttcaagacttaggtattagtcagctagtcaagttaccactagtagctgatacgcaatcaggcacttaccacttaacgatcacttctaattcaggtggcaatgcggcggccgataaaattgcgagcccgctacaaggtgtattaccgcaaatgaatgggacccagcaatggattctgttcggtatcggcgtatgtggacttagtttattaatattattaattctaatctggtggcgcaaccgtcaaacaataaaggagcagccaaaatgaaaaaatatctcggaactctcgttgcgggcatgacactaatggcgggattaccacttgttggccaagctgcagatacggagacaacgaccaaagctgaagttgaattaatccaggatgacactaataaagatattaccttggatcaagcacctggtgttagctttgggacccgaaaaaaaatcactaatgacagtaaaacctatgatgctaagaacgttactggcgacttgaaagtgaccaaccctgggaatacggacggatggttagtacaagttaaaggttcgaagttcatgaatgcagatgatactcgtgaattacggggcgccgcgttaacttttgcacaagttaatgcaactgcggatgatgctaataacatctctaaagcaaaagcttataaggtggatatcactgaccaaaatcaaattatcatggacgcagaagctaatgaagggatcggtaagtttacgagtaagtatgcaaccaatgaagttagcctgttgatccctcgctggtaacgcggctggcgcttacacttcaaccttgacatggacattaggtaacgcccctagctaaccagttaatgcgccagaggagaactgaggtgtgaccgatgaaaaagggattgttggtaacaggtcggttattaatgactgtgataggttgtctcatcattagtaactggggctggtttatcgcaacgcaagctgcaacgacacagtcacaggtgcgggtagaaatgaccccctcggatgatgacaatgcagtttctccggtcgaccctgatgatcccagtaaaccatacccgggtgacccggtcgatgaagacaatgtcgctggtacgggctcacggggaaagttaaccattgatttcgtcagtaatttgaaattcaatgcaattacgaccgcgggtgggccgtttaagacgactgccaagaatgagcgggcgatgattcaaataactgatcgccgcgccacggctgctggatggacgttacaggtcgcgccaagcgggttgcaaagtggtcagcagaccttaacgacgtctttaaaattaggcgcagtccaattacggccaggtgctggcaatgttagtactgcacctaacgttgttaatactggtgaattagttgctggtttagcgaataatgtcgtgattgccccgcctaatactggtctaggtacttggctggtcgttctgaatcgcgggcggtacccacggaacttgaagtccatgatcgccaattgcgtgctggcgactacacgggtacgctggcttggtcattaacgaacgcacctagttaattaaatggtttgatgtgaagctgctacttgtaaagaatggcagcttcaatcatacatagctcgtcacttaccgttgaataaaggaagggtaaagcctatgaaaaaaatattttggcagttaattgccgttgtgagcatcgttatggcgggtttgacaatgactgctagagcggatgacctcaattacacggtccaggctgatttgcctgataaccaaattaatcaaaaagtgtcctattttgacttgaaggtcacaccaggtcaaacgcaaaatctcactttaaccattaaaaatagtgatagtaaagaacatcgatacacggtatcacctaatctggcggttacaaataataacggtatcatcgattacagccaagcaaaggctaaggccgatgactccttgaagtttaacatcaagacagcactttcaaagtcacaggtcgtgaccgttcccgctaagtcaagcaaaaagtcactattaaattgacggtacccgagaaaaagtttgcgggcgtggcgctgggtggaatcaatatcatccaggaactcagtaccaaggcgaaacaatctagtagtggcatggccatcaataatcaatatgcgtacgtgattggcttgcagttacgtgaatctgatccaagcgggatcaaacctgtgatgaagttgcacgcggtaaaagccaagcaacgtaactatcgtaattacgttacggctaatctgcaaaacaaccagcccgttattatgcatggcttaaagatcaaaagctacgtgactaaagctggttcgtctaaaaaattattgacgacgactaaggaaaacatgtcaatggcgccgaatagtaattttgactttgcagttggtgacgggggacgcaacaattgaaggcgggcaagtacactttacatttaacggcaacggctgataagggtaagtggcaatttacaaagaactttaccattactgataaagaagctcagactttaaatgatacagctgttacagaaaaacaatcgaactatttctggtggtttgttgcgttgggcgcactgattgttgtcctattaggcgcaattatctggctactattgaaaaaccgccgtcgtcaggactaactagcgagaggagttttcaacatgtggaagggaccgaaacaaatactagttgcattaactgcattaatgggattatgggccgggaccgcccaaattcaggctgctgacgaagagacgttggcaacggcaccgtctggcctgaatcagttggataaactctttacgctaccagcggcattcagtagtggcattagtaatagtgcgaatattgggaatgtgaccaatgcaagctcgccaaatacgcgaggccgttcagggttattaacggcaagaagcaagtgggtggcttttggtcgaacgacgccaatcgcctagatttaaataaagatgctacgtttaaaatgtgggtgtatttgggaacatccacgagtactagtaaggccggcgatgggatggcttttgtcttacaaaatgatccaaatggtactgccgcatccgcacaagtcagttcgtccagcattattggtgagacactcggtgtttggggtgttgatacggataataaattgaaggacggcgaagaatttgcgaaaacggccatccaaaatagttgggccttagagtttgatacctataccaatacttcaactagctatagtaatgctggtaagggtgattcgtttgatgatggtattaagaaacaacacattgcgaccgggtatcctgggctggctagtcagtatgaaaatcagtctgtcaggagtttagacgttaccgggataatttggtcaacccggtactactttacgcagaaaacataccaacctagtgacgaatatgtcattaggagatagcaagtggcaccacctggtgatggactggcatgcggcgactaaaacgatgacgtacacttataatgacatcaatccagatgggtcggcgacgggtagcggctttactcagagtgaagtgttagatactagccaattcaacagtagtgatggcctggttcgctggggattcatgggggcgactggtagtaattctggtaataacatggtcgtgattgaaagcgcgccgaatttagttgacgtacaggcggcggttaaggttacggataagaccaagaatcgtgaaatcaagacaggcggccagctcaaagctcagcataaagttcagtacgactatcaattgacttaccaaggtggtcaaattgactgggataacattacggctgaactcaatctaccacagcatattacgtttgacagtgccaaggtaacgtatgcggatggtagtgagcagactttgacggcgccaacgagtagtgatactaaagttgactatactctagataaagcagtatcggctagtcaaccgaccgcgacgatcacgctcaatgggacggccgagaatgtcgttgtcaatgaacagacaactgcaacgacggcgacatttaaaaataaggtgtttgaaacaacgacggaagcaccggattacatgattacagtcgatcagccgctataccttaaaattcgtaatagtccgtatactgtcgccaatggggaagacgtgatcatcagagggattgttgcagccgaggattcggaacaattaactaacggtcaagtgacactacacccaacgcttaatggcaaggaaatgccaacggttcaaatgtcggatgatgacgaacaaggttacttctactacaaggtcaaagcagaggatttacacgtcggtgatgataatgagattgaactatgggcatctgaccgttacgagaacgtctcaccagttgataaagctgtgcagattattgttactgcgggtgaacttggttttaagacggttgccaaaagcagcacgtttaaaaccattactttagatggttcggctcaaacgacagaccgggaagacgattggcaactagttgtacgggatagtcgtggtaagggctctagttggcaactacaagctagtgcgactaattttaaaacaaccggtggtcagaatttggcgggcgacgtgattttccgcgacggcgagcagacgaccacgctgaattctgcggtacggtgattgacagtcacacggctactagtgataacgatgattatgatgtcttggcagactggacgaataagtcaggcattttatatcaaagcaatgcgggagctactccgggttcttacacggggatattacgtggacgttaacagatgcacctaagtaatgatcggattggtataagagaatcaaaagcactcacacgcaagattgtgagtgcttttgctttctagttacatactatgccataatggttaaagataataataattttaattaccacagttaagtgaatgaataatcagcctgaatgactgagaacgttgtaatcaaggcatttgtttatcgtgtgattagtgaagtatttacactttttacgtgtttttggttgcgttttctttttactttagtacaatgtaattgttaccaaatacatgttgcacaagcatgattgtgaatataaacacatttaaggagcgatttaaaaatgaaagttattgtaattggttgtacccatgccggcactgctgccgttaatcagattttagcatcaaatccagatactgaagtgacgatttatgaaagaaatgacaatgtctcgttcctatcctgtgggatcgcgctttaccttggcggccaagttgctgatcctcaaggcctattttattccagtcctgaacagttagctaagttaggcgcaactgttcatatgcaacatgatgtgacggatgtgaatactgacattaaaaacatgaaattacggttactgacttaaagactggtgaatctaagactgatcactatgacaagttagttgtcactactggttcatggcctgttattccaccaattgacggcatcgatagtcccaatgtctacttatgcaagaactggacgcacgctcagaatttatgggaagcagccaaaccagctaagcgggtcattgtgatcggtggcggttatatcggtactgaattagttgaagcttaccagaagcaaggtaaggaagtcacactaattgatggtttaccacggattttaaataaatacttagacaaagaattcactgaccgggttgaacaagactttgttgatcacggtatcaagatggctttgaatcaaatggtgcaaggcttcagtgatgatggtaaagaagttacggtcaagactgacaagggcagctacacagccgacatggcgattctttgtgttggcttccggccaaataccggcttactcaagggcaaagggtcgatatgaacgctaatggctcgatcaagaccaatgactacatgcaaacttctgatccagacatttacggggcgggtgactcggttgctgttcactataacccaactaagaaagatgcttatatcccattagcaacgaatgcggttcgccaaggaaccttagttggtttgaacatcttcaagccaacgcggaagtacatggggacacaatcaacttctgggttaatgttgttcggccaaaccatcgtttcatctgggatgaccctagaacatgcacaggccgaaaatgttccggcagccgctgtcacttttgaagacaactaccggccagaatttatgccaaccactaagcctgttttaatgcaattggtttacaatcctgaaactcgcgaaatcctaggtgcacaattcatgagtgaacatgatgtttcgcaatcagccaatgtgatttcagtgatgattcaaaatcacaataccattgacgacttagggttcgtagtaatggatatgttcttccaaccaatttacgaccggccatttaactatttgaacttacttggtcaagcagcgattgcccatgcggccgaagctgtcactgaataataagttaaaataacgcgatgcttaccttgcttcatgaaggtagcatcgcgttatttgtttattggtgataattgaatgttaagtggtcggtggtactaaagttaaggccagccagtatttgtgccattaggtcatcgtgctttggtaaaatcaatgtgagtcggttcaactttaactcaacggtaccaaatgccaccaaccgttctaagatttccctgagcgtagttacttgctgataagtagcagtcaggtcaacactgagagttgcttcatgcttagccgtatcgattggggcaaagccgacctgaccgacgaacgcattcgtgtctcgatccgttacgccccaaacaagctggtggtcatgaaaaatctcgcgcatggtgtggttaatttgtgcagcggttgtttccatagtggctgtcgcattgctggtctgatataagttgaaaacgtcgataacgcgcacctttgttaaccaatcgaacgtatagtgtggtgttagaatgggatgatacttttcaaattgtgacatagtgcctcctttaaaatgcgtcatgaatatttagtaattcctattgtactagttaaactgttatgaatcatgattaaaacgtgccattttttgagttcaaaatcagccagtttaggttcgctggaaacagttcgagttagcgtaaacttgcttagttagttcgtcctacgccgacttccaggcatttctgccaattgctggaacgcagtggacacagatttaagccgaagaccacgtcttaaatactggtcttccactaaccaagccaaggacgcttgctaagtggaatttcaccgctgagcattggccgaaacgccttccagtcgggacagtattcgaatggcggacatgtgcgtactcagttttttgatggctttgtcgttgtttcttataaacagtaattttgtcaatcaactgttaggctaaaaatgatattgtgatagctcgttattctgaatcgccgtagtaacaactgaacgttttggcaaagtgaagaaggcactctgatatttcacctaaagttccaatatcaaaatagccaacgacaaattgtaccaagttaagtggccgttcatctgccattcgagtggcttaccgaccggaggggttgggtgacaatgctcagtagccaaattattcttagtcggaagtgggttgcttccggcttagaataagactcgtatttgagatgacgcgggctgggcgttagctcaaatcgacgtcggcttacgttccagcaattgtcacccagccccggaggtcggaataggacactcaccggctgacgaacagtaagccaactaaatggcacgttttaatcatagttaatgctagttgttttcgatggttaccagtgtccaaatatgctgatttaagcgtcaagtggactgggattgccttgttgatgaccctcactgaaaatggcgttaagtcgactaataacacgtctgctggtgtgatttgcggtgcagtcgtgattgagactgggtcacagtccaataacgatgtaacggcatcagacgacagttctattgtaatatactaacgcgtaatttgaatgaataagacccataatgatggaacagataaaagaccgactaacaagcaatcgcaccgcttgttagtcggtcttagtgttcattgattaaagctttttaccagattttgacccgcttatctggtgccaaatacatggcatcgtcgggttgaatgtcgaaggttgtgtagaaatcatctaagttcttaggttgtacgtttgctcggagcttagctggagcgtggacgtcgattgaaagtaagagttgcatgtattcagtcgtggccttcatacgccaaaccatggcccagttagtgaagaacgcactccaaatcaacgtcatcttcgcccttagcagcttcttccgcgcaacttaagcctcccgcatcggcgatgttttcggatacggtcaacgtcccgttaactttcgcaccagcaaagtctaagccatcgaattcactgatcatggacttggcaagttccttgaagtgggcagaatcttcctcggtccaccaattatgcaagttaccgaattcatcaaatagggcaccattgttgtcaaaagcgtgcgagatttcatgagcaataactgcaccaataccaccatagttagcgctagaagattgttctaagctgtagaaaggtgcttgtaggatagcagctggaaagacaataatgttcataaatgggtggtagtaagcattgacggtgtccgcactcatttcccagcgggtccgatcagtggctttgccccactttgagaacatgtcttggcgtgccaaacggttaaagtggaggacgttgctcaatacgttgccaccttgttccgggcgtgtgcgtcttgaatttcgtgtaaatcgtttctaatttatcagggtaaccgacttgaatgccgagtttatcaagcttggtcacggctttagcacgcgtatctgcgctgagccaagtgttcgcttgcaaccggcgtttgtagacggcaatcatcttttcgaccatctgatgaacgtccgctttggccgcttcaccaaaatacttgtggccgtaatagagtccaacgacttgatcaaaagttccggtagctagatagtaggcactcttagcttggttccgcggttcttttgaccagacaatgcccgtgaataagtcgtggctaatacccgcatttcatcactgaggtaaccactgtaccgttgaacgagtttagctttcatccagttcttcatcagaccgaagttatcaggattgactacttcgttaaagtgatcgaagaaggcgggttctggcaagatgacgaggtcgggattaccatcgatgacggagtagggtggatggcggctaagtctaaataacgactagtgttaacaaaatcgttgaatttgcgaggattatacatcttactgtaatcagccgactcttcagcggatttgatccacggaacgatcaaacgatcgaattgcagcgtgtcatcaacgatttttgtgcttcgtccttttcgtaaccagtttttgcaacagttcggtcatcattttagcgtaaattgctagtaacttagggccggcctggttgccttcgtcgtagtatgtcttgtctggcaagatagtcccaggtgcttgggcaaataaggcgttgaccttggtatttttcatatcagcgtcgacatccaagctgaatggtaatgggaggccgtcgtagatccaatcgggcatccgttgttgtaagtcagcaaagtcgcttaaactatcaatttgcttgagacacggcagaattggttccgcaccattggcattgcgttggtcgaaatctttagctaagcggtaaaacttaatagaattcggttagctgaggatcgtcgggggtaactgttcccgccgccattgcatcaaagtcatgcattaacgtttttcaatggcatcaactaagtccataaagcccccggttgaagaatggtcatccggaatgacggcggttttgagccactcgccgttgacggcatcgtagagatcttgttttactgctgcttgattaatggttgccattaaatccactccctaataaattttctaatactaagttaattataccttagattattctcagtggtatcatctggtaccgactcagtaaaaaatgatactaatcatcttaatagtcccgaatcagtagcggatgggttgtgaatgttaatgtaaagggcgagattacttctgaattatcggcatgcgggagctgttagtgcctgtaaatcaccttatgaggcagtgtgatggttgacgtaaaattccccggatgactaacggtgatttcgctagtcatccggggaattaggagataatttaattagtagtcattattcagttaataatagctggtcggcatcgttaatttcgatgaccttgccaggcttttgcgtaattaggccttgacgctcgaataaggcgagcttacggctgatgctttcaggggtggtgccgaggaacgtcgccaggtcctttttctttaatggtagtttaaacgtgtcggttttgagcgctgccgctgtttcagtgatatagttcgctaaacgggcttcgacggattcagtggccgtgctggttgtttgacgttccagttgactgagacgtttgccaaagacgtttaagacgttgatgctgatactgggatatttttgcatcaagtcttgaaagtctgaacggcgaatactgcaaacatccgtcggtactaaggcttcaccgaatgaggatcgccgtttattttcaaacaaggcagcttcgccatcgatatcaccagtttgtaataggtataggagctgctcacgaccattggcggcctaactaactgatagactttaacccgcccattagcaataatcatcagtgaatccagtggatcatcagcaccaaataaagtgctaccggctggatagtggtggtgacgaacgatcgattcgatggtgtctaattgttcactaccgagttcgctaaaaattgggactaactgcacacattcatgttctgccataaggcccacctcctgaataaattcaccctaactataacagattttgcttggtagatagggtttgacgttttaaatttcccgctgttttaataactatattgtagcgtaaaacttttttgaatttcttgacggccgtcaagttctgatcaatcaaatccggttatgatagaaccatcaaatgaacgacacggaggtaattgattatgaaaattattatgcaattaggaacgttgacttgcccatcatgcatgactaagatcgaaaaggccgttgctaaccatgacggcgttgagaatgttaaggtgctattcaaatgccagcaaggtcaaggctaactttgatcctgaagtgacgaatgccgatgatttggcacaagttgttaccggacttggttacgaagttgaaaacgtcaaggttaagtaggaggaataaacgatgagtgaactaacgatcgacgaacaatacgcagcggaattaaaacagagtgacattgatcaccatgtcccaacagcgggcgcaatgacgaatcacattttatctaacttaatggttgcttacgttaagttgacccaagtgaagtggtacgttaaaggaccacaatcattggcattgcggacagcatatcaacgtttgttagatcagaatgtccgtcagtttgctgaattaggcgaattactcctagatgaaaaccagaagccatcttccacaacggctgaattaaccaagtattccatgttggaagaaaatggggctttcaagtatcaatctgttgatgaactcgtagccgcaacaatcaaggattttgatacggaagaaacctattcgttgaccgggctatcaagcttgctgaaaaagaaaaccggccggcactggcagcttggttagttgcttatcgtggcagtaacaatcgcaatattcgggaattacaagcttatcttggtaacgatgctcgaactggtttggatgaagaagatgaggatgacgacgattaggtcgttgtcgctgaagaattaaacgctctggatagcgattgtgtgggcaaactatccagggcgtttttgctattacaacgggccacgcgctatactaacgacaattaaattatatgggagggccccgagatggcgattagcgacattgtgatgtggacatttgtctttattattgcgactgggttcgtaacggtgatttcaacggcggtactgttgaagcgagcaaaacgagcgcccaaggatgccgagcagtcccacagtgatgacgacgatgactggaaaaagatgattggaaccatgatgactggaaaaagggagattgggaaaagattgactcgataagttgcctgacagatacggtgcttaactgagtcaactggcactaaaaagacggtataaccaactgagattggcgacaccgtctttttggcgttatttggtttttagcagtagatccaaggagtgttcaagattctgaacatcagccgtggtcatcgcatctacacaattattaatattacgggcgatgacgagtttcatggccttgtcgatacttgatttcactgctgaaagctgaaccaagacatcttcgcaaggacgattttcgtccatcatacgcaaaacgccgtccagttgaccagccgagcgttttagccgggtcttgatctgcttgctagtgacatattcttcagtaattgccatgattcatgatgcccctttcgtaattaagcaagtgcttttttgagttcggcttcaaaatcaggcttaggacgtgctccgaccatgtgactgacgacttggccatctttcttaatcaggaaggtttggaattccttgaacttggaattgactggccgtagcttggtcatggtcaatattcaatgaaacgaagttgacctggtccttgtaagctgggtcttcagaaagggacttaagaattgggtccatcatgcgacatggtgggcaccagtctgcgcgaaaatcaataacggcgataccagtatctgtttctttggcaaaatcttggtcatgtatttctttaatcattttagttgactcctttagtaagtatttgtcactaaacaatatacccccataggtatacacgagcaagtattctgcttctggccgtggagggatttaaaaaggactgatgtattgggtaattagataataacgatttgttgtggaagctagcgtcacctgagaatcttctagttgtgatcgcgagcattaacgttgaagatctcatgttgacgcgagcgtgttatactagcgcttcataattatacaacccagggtatctggtagaattatgttgaattattagaaatcgcttatttaagcaaaataaagcgtttacataaacagttttatctggtatcttcaaattatcatagatgctcggtaccttacgaggaggatttacagatgacaggttcatgggaagcacgctacgccgctgaatttttggcacgctgatcctagtactactaggtaatggtgctgtcgctaacgcattcctgaagaacacgactggtaacgatgatccaggactcgccaatggaggatggctcctggttgcatcgggatatggactggggtcatgctcccagccatgatgtttggctcgatttctggtaaccatttaaaccccgcgattacgattgggcaagccgtgattggaatctttccctgggcgcacgttgcgccttacttaatctggcaatttctaggagcaattgcgggccaatgcttgattttggcactgtactggccccattatcggcaaacgactgataatgaggcagtcttaggggacacgacgtttgcaactagtgatcatgcgaacagtcagttaaacggttttgttacggaaatggtaggaaccgcagtcctgatttttggtgccatgggattatatcgcgggatgttttttcatcaaaatatcgatatcgccaatattggcgttggacttttgattgctgccatggttatttcgttaggaggtccaaccggtccagccctaaatccggcccgtgacttgggaccacggctagtacacgcgttattaccagtaccgaacaagggtagttctcactgggaatatagttgggttcccgtggttgccccaattgttggtgccgttattggaatttggatttataagatcttttttggtttataatcgcaattaattaaccgagcgtatttatgaaattattattggtctatcatttttgattgcaatatgataaaacggtccgccgactagctggggaagactagtcggcggaccgttattggttgctaggcttgtaaccaaagttggggagacttgattaagctgtggctgcttgaatggttttagttggttggtgcttgtcgaacttggtttggaaattgattaaccgcatagcgttgaagataacgactaagatactagcttcatggacaaacatcccactggccatgtagatataaccgaagattagcccaatcagtaggaaggccacggtggcaatggcgatgaagatgttttcacgagtgttcaagacagttttcttggcgagaccgtgggcgtgtactaatgcggggaagcttgattgcatcaagacgacatcggatgtgtcgatggcaacgtcagtcccactacccattgcgattccgatatcggcgttagcgattgaaggactgtcgttgatgccatctccaataaaggcgaccgtgttaccggctgcttttagtttcttaacgtattcgactttttcttctggcaagaggttggcgtgaacttcatctaggttcaattcgttggcaacgggccttgagcggtgagttcattgtctccagttaacataacgagtttcttgattccttgggcttttaatgcggcgagggaatccttcacacctggacgaatcgtatcggcaatcccgaagatgagttgaacttgtccgtcgactgccatgataacggttgattgaccaccagcttgtaaatcattgagatctttgagttgagtaggatttagtttgatattatgagccgtcaacatttttgattaccaatgacaacttcttgcttaccgacttgtgcacagattccttggcccttaacggtttcagtgtcatctaggacgggagcgacccccgctgactgctggtcggcataactgacgattgcttggcctaacggatggtcggaaactccctcaatagcggcagcgagagctagttgattatccgcattgtttgtgtaagtgtgcatggttgtaacggcagtgttaccttccgttaaagtaccggtcttatcgaagaccaggggtatcgactttggcaaaagtatcgacgacttcaccacccttgatcaggataccacgcttggcaccattcccgattccggcaacgtttgacactggggcgccgataactaaggcacctgggcaaccgagaaccagtaccgtgattgctaagcggaagtcacgggagaaggcgaagactaagactgctaaaacgaggacggcgggcgtataatattgagcaaagcggtcgatgaacttttcagctttggacttggtatcttgagcttcttcaaccaattcaataattttggcaaaagtcgtgtcgtcgccaacctgagtcgctttgatcttcagatagccattttcaaccattgttcctgaataaaccgaatcatcgagttgcttgttgatttggtgtgcttcacccgtaattgaggcttcgttaaggtaaccgttaccttcaacgacgatcccgtcaacgggaacctggctcccggttttaactaggacaacgtcacctttcgtccacatcatcaacgtcgacttcttcggtgccatcatcagtaactaaagttgcggtagttggtgacatgtcagtcaagcctttgattgcggtccgcgtcttctgcaaggtcttgctttcgagataggagccaaacaagaagaggaaagtaacgattgcggattcgttgaattcaccaataatgaatgccccaatcactgcgatactaactaacagttcaatactgaaaactttgttccgaagtgcgctccaagcacgaaccgcaatcggaatgacggcaataattgaagcaactgctaaaatgacttggtaaccgagcgtaaattgtaagagatatttactgagcatcccaaggacaatcagaatccccgtaactaatgtaatttgattcgtatgtttagtgagaaataattggaatttcataatttgcaactccttatttgatttgatgaccctagtatagtgagttcagcttgatggcaacttgataggcgtcaaggtggttttgcaaaataacagtattaattctggattgctggcagtgattatgattaaaacatgccatttagttggcttactgttcgtcagccggtgagcgttctattccgacctccggggctggatgacaattgctggaacgcagccgacgtcgatttgagctaacgcacaaaccgcgtcatctcaaatacgagtcttattctaagccggaagaaaggcacttccgactaagaataatttggctactgagcattgtcatccagcccctccagtcgggaagccgctcgaatggcagatgaacggccacttaacttggtacaattggtcgttgactattttgataatggaattttaaacgagactttaaggttacattaaccactttgtcgagacgttcgattattactatagtgatttcgaaatagtgagctatcaaaatgttaccttctacctgacagttgctcgacaaaattactgtttataaagaaaaatgatgagaggtccaataaaagttgggtacatctccgtctgccattcgaatactgtcccgactggaaggcgtttctgacaatgcccagtggtgaaatttcacttagcaagcgtcctttgcttggttagtgaaaggccagtatttgagacgtgtttttcggctcaaatctgtgcccaccacgttccggcaattggcagaaatgcctggaggtcggcgtaggacgaacgaactaagcgggtttacgctaacccgaactgtttccagtgggtctaagctggctgcttttgaatttaaaaaatggcatgttttaatcatgtttcatgacaagttaacggaagaataggtaggatgatcaagtttgagtaaacaagaggtataggagggaaaaacgtggattatcaaataacgcagccaatcagcccttgatgccggcatactttcaggggcgttgggcggtcaagcaaattgcggatcgagacgtgatgtatagcactaatttgggtgctgaagaatcgattttcaagtcactgatgctagttttgtgaggttgacattcttgccgttggcgtatgagctaccgagttgggtggcgattcagattgatggcttgccttttcaacggcgaggcggtgacgaatgccccctatggttgacactggatggtcggcctcacgtggtacgggtagttttgagtggtaatactgatgaggaccgtgtgtgggatggcaatcaaggttttgcagtgaaagccctgacgacagatggtgagttacagccagttcagttaggccgacacagcgtgacgtggattggggattcactgatggccggttgctgggtcatgggtaagtacccgccgaagattatcgcgcggaagccaactatgcggcggttgcgagtgacttgttgaatgcacggaatgtccgcattacttatagtgccgttggtctcagtaaaccaggaactggtggcgtaccggtactgccggaggttttaacagccgtggatagtaaaacgacgtggcaaccagtacccacggatttagttgtgattaatgttggtactaatgatcggcacacggatgatacgacgttcacggtagttttgcgtcgcttccttaatcaggtgcagacgctttacccgaatagccggcttgctgtaatgatcccgtttaatcagaattttgcagcgattattcgcgcggtcgtggccgaatttatgcaattgcaactcattgaaacggctacttggcaactcagtaccacggacggggtgcatttagatttagctggctcccggatggcgggcgaattaacagcacaagcgttgcggacacagtatccagatgtttttaaatcgtgatcaacccatcttataaaaatcccgttttactgtagcgatgttctgctgcagtgaaacgggatttttggtggcactactagattttaaaaataaacgttaacgctggcggtgtagtgattgcgactgtaaataccgggccgcagcgagcaccttttcgggaatatccacatgggcgatgaagccctgaccacggggaccataaccgttgggggtatccactaggcgttgaaattcaccgagtaagagttcagtaaagtaagcgggttgccagccagctaatattgtgtttggcgtaaattgcattggttgtagccggtttaattgcaaggtcgccggcgcatagcgaataaagttggcattgggccaattggctgagaacgttagggtagtccgccgcgcgagtaacgggtcttgtacgagtaggacgtggcgccaatcggtgggggctaacgcgcgggcatgcgtggcattgctaccagtattggtagaagtcttgtcgaggcggatactaccttgatagccagtctttcgaacaagcgtcgccatcaactcagcctcactagcttgagattttggcgggtttaagttttgccgcaaatacttagtggcgtggccgatgccgcccgcaataatgagtagtggtaattgatagtcttgggctaactggcccgctgcagtggctgttgctgggaggctgttgccacaaaggaccaggccatcgaggtgctcaggcaaggcggtggtgtgtgtcaaccaagccagacattgattgaaagcggtcagttcgtccaattacttggcctccttagtcccaaagtgagccgctgcggctccaaagttgaaccgttggaagtgaacattttgaaagccgcttgctgaaacatcgttgctaattgttgatagcttgcaaagtgacgagtggtttcctgtaaataggaatattcctgatattgatgggcgaataagcgcccgaatagtgggactacttttgtgaaataccactgccagaccggtttaatcaatggctgatcgggttgagacgtctctaagcagactaagcgagcccctggttttagtacgcgataaatttcagttaaagcttgggctttatcaggcaagttgcggagcccgaagccaatccgtgacgaggtcaaaggtgttgtccttaaacggaagatgcatcgcattgccgcggcgcaaccagacccgatcggcaacctgttgctgggtcactttttgttgtgccagttttaacattggggctgaaaagtctaatccgatgacttcaccgggtgcctgtaattctttagccagcgcgatcgtccaatcacccgtaccacaacagaggtcgagaacatgggcgttaggcgctaaatggatttgggccatcgtttgcttgcgccaatgacgatgcgttccgagactgatgatgttattcatccgatcatagttcggcgcgatggtgtcgaacaaaccttggacattatgtaaatagcgatttgccataaatgatacctcctgatagttgctttacttactactatagcagatgttggttgccagttaccgtgaaaaggaatgataatcaatataaagccacgatattgagttcgctgctgtcaatattgttcgtgaataattaaaccgttaaactaaagttaaaacaacataaaggcagtctcgatcggtatgtattaagtaccaatcaagactgcctttttaacagcgtgttcctagtcgaagccttaacgtcaaaacgagtacgctagtaatagcttaaaaatcattatctgcaatttgagcgaacaggtcacgtgatgggatgaagaacgcttgtccggatagtaaagttgagaaagttagtaaaaagtcactttggtcgaccatgttttgcagcatgcctttggtaaccgtccagtgacgggcataaccaatgaagtacgtccctgtgttaccagctgctggattggagtacgggacattcatccgaacgattttttgttcgacaccatcaatttccaattttgaagcaacgttgtgagcattcttaaacttgtcttcgtcttctaactcgaagtcgctgaatttttcgcggcccacggctttttcctgatcctcggtgtgcatatgttcccacacgggcatatcatgttgccatttctgtgcaaaggcgtaagaaccgttgatgaactgggggtcttcgtcaccaactaaggcataatcagcggcatcttctacggccggcgcttccgtaccgtcgataaagccaatgatggcccggccctcgaagtaacgaaagcctttcgtctcatcgaggacggtcgtaattggcgctaagacccgctggaactgcgtttggcattcgtagacgaccgcttcgttgcttgcgcgaatgtggaagaagaggtcgccgggtgttgctggcatggtgtatttgggtccacttaaggtggtgtaggtttctaattctttaggtttgggtgcgccaggaaacaggtaatcccaagcggcactactgatgccgatgctaacttttaattgggtgccagtttcaggtttggcgtcccggatgcgtaatgagcgaatgatggcttgtgaccgatctgcaaattcttgaaagacttcacggtcgtgttgctgatcccgccgatttaattgaagaacggtaaattgaacgtgttcaccgacatccttccagacatcttgggcgcgatttggattgattggcatgacatatttcctccataaattgtttgatattgttagcgtacatggtggtaagggtagcgtcaaataaaggcaaacggcgggtgtgaataatgacgacattcgccagcatcaggggtaggcggccaaactaacgtggtgtgtatcctaatcactaaacggactagtcggttggaatcgttggtgcttgtaagacattaggaattaattgaataaatagccggtaagtctcaattttgctgagtgttgtctgtgtggttgcaagttgccaagctaactggtgaagacagttgccgagataggttgccataaaatgccgttgcttaggatggatggctaagctagttagtagctgttgggcaaagccaacctctaatgggatgacccgctcgcgacactgggcccatgacacgagtaaggggaggcccagatgtgcacgaatcgtcgtgacgatcgcaccagcaatggtcgcgtaagatgtggtcgttaagtcattcaacgcgtgtcctaactgttgtaaggcaattaagtattcaatcacaatgatatcttcaatatcctggtgatgacgataaaaggtggcacgtccaacgtgggcatccagacaaagttgtttgacagtcaactcgttgaaggacttttgagacttaaaattcgcttgcggggcagtaatcaatttacgatgagtttgatgagttcgctgatcaatatgcaattgattgttcataattaattttgtcatatgttaatgatacaccagattacgatatgtctcaaaacgtccctttttagcatatgaaagcgtctataatagctgtcacagttagatataactgaccaattaaggagattgtggactaatgaaattaattaccgttgaagagcattttgaatcggcagctgtgactgccgcgcaatgcgtcaagctgttggtaacgctgtgttaccagcagttagtccagcgctacgccagtacatgcgggacaatttaccgagtccctgcaattatgcaagacacccagcatgaacgtctggcatttatggctcaatatggcattgatatgcaggtgttatcttatggtaattcatcaccacagaacttatcgccggaacaagcagttccactctcacaattagctaatgatgaattagcgaaagcagtggtagctcatcctgatcgttatgctgggttagccgttctaccagttggtgatccgcaagctgcggtcgctgaattaaaccgagcggtgacgacgctgggattacggggtgtgttgctgaaaggaaattatcagaataaatttttgatgagccattcttcttaccaatctttgaagcagctgcggcgcttgatgtccctgtgtattttcacccctcatttattccgcaagcagtaacgagtcattatttttgaaagtaaccaatggtctgacgttgtcacggggatcttatcatctgccggttatggttggcatatggatgttgggattcaagtgatacggatgattgctagtggtatttttgataagttgcctggcttgaagctcatttcaggacactggggcgaactagtcccactatttttggaacgtttggatgatgagttaacaacatatacagacttacagtatccgtttagtacttattatcggcataatgtgtacgtgacgccaagtggtattttgagtgcgcctcagttgcaatttatgttagcggagatgggggcggatcacctgatgtattcgatcgattacccgtataagcagccggagacgagtggaagtttcctggatatcgccgacttgaccgatgaacaacgagctcaaatcgcgtttggcacggcaaccacgttatttaaattataggaggaacgaaataatgtcattaaacgcacaacaaatgcaggcaacccggatgaattacaagctaactttgcgttgactggtcttacgaaagcccaggtagctgatgatttagggattagttcaactaagctcgatcacttatttgacttaacacaacaatctttgaacgatccgtggatcttacgtaattatttgattgaaaaggtggaagcaggcgggaagacgccggtgccatttacggcattaagtggcgactggcatcgtcattggtttttgaatagcgctgtcattgatcgtcgcgaaatgtcggccggtgattgctaaaatgattggaggaaatcgtcaatgagtaacggaactgatatggcactaattagtgaactagtggcccgtgagcgcttatttcgtgcccggcataaccccgaaatccgagattgctattacgccgacgcgactgtggcaactagttggcaacaaggaccactaagtacatttattggcgcagaatcgaaggaagttgatccgcgctttgttattgtgggcggagcgtcagtacgcctgtcgttcatctgaatggcgataaggcatacgtggaactaccaaccacgacgcatatgcgcatgatggtcaatggtactttagcggaattagaatcatatcggcgactgatttaccgcgtcgaacgccgtgatactaagtggaagattagtcgattgacctcaattaacgaaagtgataatttacgaccagtcattgtgggacaggatttacacgtgatacctcaagattttaacggtttacggtcctcgtatcaattcctagcctatgtccgacaagctgtcggtggtcaaattagtcaggatttattagggacggatcgaccagaagaagttgagcgattgtacaaggaaacgaatgcgtggttgcgagctggagtatagttgaatatgaagttagcgggctatctgttagaacgatagctcgctattttttgtctggtaaatacatattgtgaagaaacaaggtacttgatattctcagaatattcaattatttaaagtatcctaattagagaaataatcaataagaatttaggagtgtaaaaataatcgaacacgatttagctcaccaactcaaagcagcaagaattgacaaaggttactcacaaaatgatattgcaaatatcctaaatattactagacaatcagtttcaaaatgggaacggggattggtatatcctgatttagataaccttattcgtttaagtgatatttatagtattccggttgataatttaattagagttaaccataagaaacaagtagttgagcaaaagatactgctaacgtaaaagttagtcatgaaaatttgaaggttgataaagttaatgttttaaagtatcaaaatgtgatgaaagggttgctcttgatgatgctttcaattatttcaacattaattgcacctattggcgttttgatacctagttatgtgatatggcgaaatagtaagcataatattttatacaaatcaatcattgctgtttcaattattgcaatagttgttagtcttgtaaattgttttgtgatatacaatgataatttttcgtggaataataaaacgacagtatatccgattaagtagtcgagatgaataattttttttgtttttatctttgcaattaacttaataatataatttactgtcccaacctttttgaccattcttagagttactttactattgctgtttcgaatgatttttctactgacaattttgccaatgtaagaaaatgttttaatgtgcgaaactttgatgatcttgtttccttttgttttaatatcgtagcttgccctccaggataacgaagatgtgtgtgctacgtgtagattggcagcgctagctggtaattcaactgaaagaattatagtgagtgttaacataatagtagttattttttttcattaacttaacctcctatcgagtaggttaagttaatgaaaatctttagataagaacctagtaggctagctatgtaacccgcctaggttaggttctttagtgatgattagataaaagcgcccgccagtttctaacagcaaccaatatattctttgaagatttgattattagccagataatctagtataacggcaaaattttatagccggaaataaatttatgggaggtaatgtaattatgatgattaatggtcatggctttggcccagactatattgttgattctggggttgtattaattgttttaatcccgctatttttggcaatccttgttaggcaaatttctaaaaaacgcgtgactttttttagaataagtggattgataatgtttttatctatatttatgctctgataaaagtgacgatttttccgatgatgatttttaaatttggatcaaaagcatatcgttatggtttcggaaaacagtatctggctaattttaatgttttggaaattagtaagtacacaccaatacaaatttggggcaatattgcgctaatactaccactgtcgattttgattgcctactctctttggccgcacaaattgagtgcgtttaaatttaatatttgtgtaggaatacttacaactattggaattgagatgacacaattaataatggcctttttctatcttggaagtagaacgtttgatataaatgatctcattttgaatttgctaggttacttattgggattttgtatttataaagtgataaaaccaatatttaacatagaatcagatatgtttagagttttttaattaaaggagaagatatgaaaaagggtagcgtcaagaatcttgtgtaaatgaaatgccttcgtacatataatatgtatctaacttaaataaatgatgcttccaaggtgtcctggagtcctttgaaccctcggtggatccgcctcagagacttctcgttataaacattaaactgagaaaccagaaagcgatccagtgaatcttccgttggaaattgttctttgtggtgggtggtgcgcttgagatgcttattaaagttctcaatcaggtttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttggggaaatgccgattcaagccttcatccaaaccaactaacccatcggccacaaacaacagcacatctttaacgccccgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaaggtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaattgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaattccagcgtatgagtagcgttcgtaacccaaaaaccccgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctcgaaaaagctattttactaatgactatgatcttatttgtaagtggaacaatcacattaaatgcatatgcagcatctcaaagtgtcaatgtttcatataaaacttacggatcagcgaatggacgatccaatggtaaaactaatggtgtttggcactatttgcgaaatggaaagtatgggtatttaaagattaccagtaaaacaggtgcgggaaaaacatacgctagcttatatcgtagtgtagtcggtccagataaaaagtttggtactgtaagaactagtaaaggttcacataagttttctggaaaactaaataaaacgagcggtagttattatttgatatgttacgggggcaattcgtcagttacaattcatataagaggaaaactttgtgcacgattagtttattaggtaacaaacgaataaatagtatttgttttgaaataacgcaatgttacttaaaaagtgcaaatgtaacttagaagcgaaaacaaggtgtgttgcaatcgacttcgattgcaacacaccttgtttttgatgtctattaaaatggaccctaccggatttgaaccgacgacctcccgcatgcgaaagcgagcgctctcccaactgagctaagggcccaatacacttttagtataccgcaaaatgctagtcgtgcaagtctagtttggtcatcaatggcgactagcacgatgattttgattgccacgaattttatgcactcgtcgtttgtactgtgctttttggttgctgacaaacttgaagtgttgcattttgccgccgaagacttgaccattcagccttaattttagccaatcttgcataacggccatcattgaattaatttgggtgatccgtaatttgtcatgttgttgttgtgctagtgggtaataaattagtagctaactgattaactaatttttgatggtaggccattaattcgggtgttaatggggcatcggtataagtattaaataatttttggattgtttgaagtgcatctttgatgtcggttggttgataataacgattgtctgtattcgtcaagttaatttcccctttgtcattttagtatagcaaattttatttaaaaagcatggtttagcgtggtcaaagtcagcggtggcggttacaatagggataaatttaggaggtgcgcatcatgaccacagtaaccgcattggaaactcaagcgggccaagtcttggatcagtcctacgcccagtttaaacaagcccagttggcgctgggcaaagagcagatatttgctaatgctgctcagatttttacggtcggtgaaattgctgccgcgacacggcaatatttatttgacgaagagatcgcacagcaagtgatcaagttgcaagaccatgtattaccgaccatgtatcaacagggacaaagtggcgaattcttgaagttgaactttacgggtaatgatattcgatggctattaggattaccgcgaacgcatcatcgccagcgaatatctaaatagtccaaattaaccgaacgtttggtcgtaattaaattgaaatttaaccgaatttccaggaattgtcactggaaattcggctttttaaaataaaaataactttttttcgtcaaagttgctaaatagtttcaaattttagtaataaaacgatgccggtatgatagggtttcagcgcggaaatgttacgatggctaattattgttacggttttgtaactttcgtaacatattgttattttgctggtattggtatgtaacacaaattgagtagtatagacgttggcttgaagtacatacgtgacattctttttggagtgatcattattaaagtgaaagtaaatattaaacaagtgatgttaggaactgctgctttagctggtatgttagttacattagtcaagcagttgccaatgccgattcaatgacaatcaaagcaggggacactgtttgggcatacgcacaaaagtaccatgtttctgttgacaagattgctgaagctaatggcttaagcaaccctaatttaattattgctggtaagaccatcaatattcctggcgttaagactggtgaaaaggttacgactaagacgactactgctagtgcaagcagtgctaagtcaactagtgccgcaacttcaactagttcacaagctactagcgctgctgctaccagctcatcaactactagtgcaagtagtacgagccaagcagtatcaagtagctcagtagctgctcaatcaagtagcacttcaactgctagtgcaagcagtgtcacttcaagtgcttcaacgagttcagtagcttcacaagctagctcaagtgctgtaactagttcagcaacttcacaaagctcagctagccaaagttcagcttcacaagtatcacaaagctcaaccttcttcagtagcatcgtctactagcacaactgcaactagtacgcaatcagctgctgcttcaacgagctcacaagctagctcaactgcaagtaacacgactagttcatcaacaacgcctgttactgcaacggcctacagtgcttcagcatcaactagttcatcaacaactggtactgccagtgctttgattgctgctgctaagacttatattgatacaccatacgaacaaatggactgctctgcattcacgcaagctgcctttgctaagattggtcgttcaatcggtcggactacttacaaacaagcaactcttggtagccacgtttcatttagccaagcacaagctggcgacttgattttctggggttctgattcagcaccttaccacgttggaatttacttaggcggtggcaaatacatcgcttcaccaactaatggtgaaactgtttcaattaagagcacgacttactacacaccaagttttgctatccacatgttctaaaacaaattattgagatattgaaagccaccatctggcaacagatggtggcttttttgttagcggtcgttcatacatatccactggcttgattagtgtgtgaatccgtatttcttaggtgccgcgtcatgatgatagacaatgtgggcgtggtttaagtcatggacagccttggtcaggtcatccatgaaatcgtgggccatattcatgccaaagtcagcccgaacgacgattcgttggatgacttgttgttccagattagcaggtaaaggatacgttggtacttgccaaccgttcattaataggcgatccgataaatcataaagggtccattcacgatcttcgcgcgaggctagttggtaacaaatcaggggagttggtgtccgttattgatcatcttaaactcaccaactttatccagagcggctgccaggtagcgggcaacatcgtgagtctttgtttgaatctcgcggtaaccgtccataccaaagcgaatgaaatttatagtattgtccaatgagctgggctgcactatgtgagaagttgatcgccattgtcggcaactccccacctaaataactaactttgaagactaattctggcggtaaaaactgacgatcacgccaaacgacccagccgaccccgggataaactaaaccgtacttgtgcccggaggcgttgatcgaaacgacgttagccaaccggaagtcccagatgagttgcggctcaataaatggggtatagaagccacctgacgctgcgtcaacgtgaatgtagactggtaatttgggatgctgatgattgtagtgagtaacgaccttatcgagtgcggctaggtcgtcatattgaccggtataagtgatgcccatgataccgacgataccaattgtgtattcgtccacgtagtctaagacgtggttaacgtcaagggccatgtgttgctcatccattgggaccacgtgcatgtcaacgtcccagtagacacaaaacttttcccagtgcaaacttgatagccagccgaaataacgaggttaggtcgatgggcattcagatctaaacccgccgcttgagcgcgtttacgccaggcgaatttcattgctaaaacgcctaacatacaagcttcagaggagccaatcgtagaggtacccgtaaagtgttcgtcatcaggtgcgtgccacagattggcaataatgttcacacaccgattttcaatctcggccgtgcgggggtactcagatttgtcgatggcattcttagccagcgtatccttcatcaattcaacggcttcgggttccatataggtctgacaaaaagttgccaggttcagtcgtgaattgccttcatctaataattcatcacgaactaagcgatcggcttctcgaggggataatgaatgctttggtaaccgatacttaggaagatcatgttgttcagaaggcgcaccaaagactggttccaagtattcttcagcttcatgattgtgtttaccgtataacacatttgccatgttggtcacccttatctttataagttgtgccgagtatagcacgaggtgataacagggtaaattaaaacgcaatccggatggtaggtaacaaaaaaactggtcgaatggacgaccagtttttagtgaggatctttgccccaattaggctttatcgctgaactagcagttaagctttggctttgctattcatgaatttcttcaacagttgcagttcttcctgagttggcgttgcttcaccagatttaatgttgtgaatccgttcaactgataattgactgccaaacgcaaggtcgttatctgtaagatggtgctcgcgttcaaaactgatgagcttttctgataattgacttaatggtagttccatgctcctcaccccgatttttagaattcgtaaaagttcagtgccatataccgctacttttattataaccttaattggtctgaagcggggaacgaatgccatcctattttgtaattggttgttttaattgaatcttgtaggtggaccagaatatcagtaatctcatggggaagctggtcatgattgttgtgttgatattgatcaatgaagttagcccgaattcctaaacgagtggcgaccaagttacggtagtctgcattggcataatcaactgggaaatcagctaactttaggttttgcatgtgctccaagctcgcgaatgactcccactcggtcgtatcattgacaatggcttccagcgcacccaaggtaacttccttaggaatcttcttatcgccaaagaagccagtattcaatagataacaatctaaatggcgttcttcgaagagtgccttgaaatcatggtaatcttctgatagtggatagaccctaaatgggtttgcaaatggttcgatcactagggcgttacggtcgacattaccaataatattttcggccgagctccgtttggtcgctaaagtggcgccgaatgtcgctgctaatacgggatcatctactttaatcacgggtggtaagctatcatctttcataatccagaagattgcattgatgggagcggcttccttatcaacccggttagtcgaagcgtaccgtgacttgatcgtccggccgttaccgttgcgcagatcttcagtgacaaggaccttgcgaccctgatcgtctaaggtgacgccgacgttttggatcgtcataaaatacttggtctcatcggacgtcatcggatagtcgttggttttgtcaaagtaagaaggctcgagggccacggaactaccatccttgcgattgatgacaaaggcgtcgtcgtggagaacggtgatatcgtatttatagccgtgtttagcgtgggttagtgttgacttaccggaacctgataacccgaacatggcgaagacttggtcttgcttgtccttgaagtggaaggccttcaagccaccgtgacaagcaacgaagccgtgacgatgggcgatcgaccaagctaaggtcaaagtcgatttcttcaactcaccaaagaatatatggcattcctagaatggcagccgtattatgttgcggatcaaaaatagccaggccgtctggataatctggatcatggtaagtagggtcagcgtaaatgtaaatatcgccttctggataagcaacggaccgatcgaacatttcttgataagcagcggtgatgggctggaagttaagcatgtaagaaagtagattattggcaaaaccgtccggaatcgcgaggtgggcccgcacgatgaagtcttcgtctaaaccgaccagaacgtccgtcgtgatgaagtccttgtgagcactagcaaatagtgcttggcgtaggcgaccggccatatcggtttcgctaacgcccgggttgcctagaatccggcgcgcttgtgcggttcggccaacaaccttacccgtattggcaatcaacatttttgcatcagctggtaagcctaaatccgttgcgcgatagattgggaggtccgtaataacggttccggggtccttagtagcgcggtggtaagcggcagcgatatcatcaacgtggtgcatattattaccgtaaaaggccgtttcgacggtagaacggatctgtgaaaagatcggattatggcgaccgatatcggctaattgataagaatttttagtgctcatattgtagcctcccgcaagttgataagttaattttagcacaaactttcacacaagaaagcgttttctttttggctgatgaatagctgctagtgcgtttagacgattaagacgttaagccgcagtggttgttaactaacttgtagttggaaatactcgcggattttattgataagtaatgatcattctgatagttgaggctgttattaattaactttccaattaaattatcacttgcgttcaaagctatattagtatagtttattaaaagagaatgattgaaaatcagtgatagggaggcacctttcttgccacgaagaaggaacacgcaacggcgaatggagattgttaatacagcgtttcgcttgtttgccgagcgggggtatgcgaacgttcagatgaaggacattgccattgcctgtgatatcagtaagtcgttgctacaacactatttcccgaagaaaatcgttttattaagtacgatgttaaatgagttgacgcttagtgcttttatctatagtaatgaacagctgaccatgctgtcttcgtatcagcgaacaatgattcaaatgagctttgttttgcggatgttagatgaaaatccgaccatggaacactttattcaggacatcttcgagagtccggaactgacgactgagatggtgctagtgacactagactggctagaagctatcggcgtagaaggtgaagctgctatgattagatacgcgttgaacttcgcgttatctggtggtatggctgtttttttcaagcgtaagattctaagagctagtgttggcatgattgcagagaatatcgaccaagcgttttacttgttattaggtgagaatactgagaaaattgatcaaatttatttgagcacagccaagtataatactgactattattatcagcaattcatcacgtatctgcataaacacgcgacccttgacttgagtactgaaataaaaatttaatattaaagtaatctaaattacttgtatttcgtaaaatatactagtacactttaaagcggggaaatgataaacgacgcttactaatttatgaaaaaaaaaaagtatggggcgaattatgattgggaatttaatgataattcgactagtgaaagggagacttgaataatgaatgaagatatggaattttttaatcgctttagccatatgtatttacatggctttaaaaacttatcagatatgtttgctgaacccgcaacggaacatgggattactttggatgaattttacattttatatgatattgctgaagcaaaaggtaagatccgtctgatggatattgccgaaagtcacggtgtgacgcgttcagcaatctcacgcttaattggtcagcttattacggaaagattacttatatcaagaagctgaagaccatgaccgtcgtaacaaagttttgaagttaacacctgaaggcgctcggattgaacatgaagtctttactgaattgattcaacgcaaccgggaatggcgtcaaagcttcagtttagctaaacaatatcagactttgaacttggttgaagagtttatggacaagtttgttaatgaagatgctagcaagcaaactaaaaagacaacgtatgctgatactgatttgaagcgggctgaagcttaattgagtgtcagttacaattaaagataattacaaaaacaaccctgttggcgtcttttggtgctaacagggttgtttttataatcattaatggccactgatcgtgattcggaaatgatcaagacgataggtgctatgaagtctcgatggtaataggtgtcaagctggttgtttgcgctatcagatataatccgtgcttgtacttaaaataagacttatatgtagtaattatttttgggaaaagtgagcgcttactatttgtatagtagtcacattgattgggtgatttgtataaataagacgagcggacaaatactcgtcttactcatatgaactttggttgccttttaacctaatagcgcgttcaaggtttggttaggagcttgcttgatattgcagaattaatatcaagtttaagagtgattaaacttatatgcgaattttaaaacacaaaaaaatattttattgtacaaagtaaatatcctatttattcttctttataaaaatttgattcaactcgcgatatttactcggagtaatatcgaattctttttgaaactggcgtgcaaattcggcgctattgtagaagttgattctttctgcaatttcacctataggaagatgggtattaattaataattgctttgctcgctgtaatttagcgtggcgaatgtagaagttgatggtaaaccctagttctttacgaaatttacgcttagtgtattcaggatctaacgtcagttcttctaagatggtatttgctcttaatggctcatcacaatgattatcaatataatagacaactagcgcgacttgcttagagaggcgggtaccatcaattggaatatcaagtgtatcaagattgctaaaataattgttaacgattgactctaaaagtggcataaaatcatcattcgttagtgttgttgtcgtgaggtaatgcaaaatgtcctttcttaagttaacgaatgtgatcatgttcaaataatgataaaagctgacacttgctagatcacaggttagtgaaattaaggcttcttttagaatgagtgggcggacgttgtataagttatccttgattttgtgattaaatctattgatatgttccaaggcgtagtcaagacaacgcttttcgaaaaaataacttaaatcatgttccaatatagcaaaatcaaaattgaaatcgcgttctgtttgagaaagtttgagctctggaaaaattcaatggacagttcctccccataagttacaaaaatagtgaattttatacaaatagtaaacgtacataatagtgtacttgattaactttaattggttcaaggataatgactgatttaagttatccagtatagacatataaatattcttcgtcaattagtttgctaaaagtttattaataaaggtgaatttataatattgatttaaatattaatatgtttgtacaaaaaggtattacgcgctattgatgaagaagattaatatgctaattaaattttaggggaattgacttatgacaaagtcacgtacgctcaaagcagctatgctggtttcagtagccagtattacttgtttatcattcaataatttaggagcttccgcggacaccttgccttcaactggaaagtctcaagcagatgtttcgtttacgtctaacggtggttcgactaatcctgttgatccagacaatccggataatcctggcggcggtggtactgggaatccaacgggccactttcgttagatgcggtaccaacgtatcttaattttgggacgcatacgcaacctaatgttgatacggcctacactttactttcaaaagatgctagtcaggagagccttgcgacagctaatgatgataagacccaaaatgtgacgactagtggtaagaaaaatggtaatgatatcatttacacgcaagtttctgactcacggggactggtgctggctggcaattaaaggcacagctttctgatattacggcttctgacggccaagtgttaacgaacgcgtcagttgttttaagtggtgggacaccacaatatctgacaggggaagctaatcaacaatcttgggtcactgcggcggatgcgaaccaggcaaccgttgcaacaccaattgtgctcaatgccggcgcttcatcgacaaccgatgttgcaacagccacggcagggtctaaagttggtgacggtcaaggtatgggagtcaaccaacaatactggaagatattaataatgtgcaattacatgttaaaggtggtcacgcagccgctaagaattattcagggaatattgtttggacattgaactcgacaccaacggcttaatgaacgaaaacgagtggctatgttgaatagttaactcgtttttttgaagggaggcccttttatgaacggctggaataagaagctattattagggatgttaaccctaataatgactttgttggctggtatgactgtgattggccatgctgctgacacggccaataatgcggtaacttttgatgttcagccaatgcttaatgaaaagcaacaattatcaaaggacgcttattattgggattttaaaattcaaccgaagagaacatattcgttagcgatgcgtgttaataatcgctcaaatcatgaaattaaagtcaaaaatcaattcctacaatcgtatactaatgcgaaaggtgttattgattatggtgctgctaatctgaatgatgatactagtttaaaaagtaaaactagctgatattattaccgtaccggatgaggaaacgacgattccagctaataaatcacggatcgtgcgggcacagttaaaaacgccaacgaaattgaacaaagggattattttaggaagttggcaagttaaaattgcagatcaacatcttaaaactaagggggcgacgttaactagcgaatatgcctacaatgtggggatcaaactaacgtcaaatcgtgatccattgccaaaattacgcttggctgatgttcaattaaaaaagcggagtggcatcaagacagttatcggtaatattcaaaattaccacgcttcaattctaggcaaagggactgtcactgcctacgttagcaaagctgggcagaccaaaaagctcgcggtggctgatctaaaaagtagttcgatggctcctaattctaactttgacttaccattaaagtggcgtactaatcggggatcattttacctgggacttacactctatacgtcaagtaatcgaactacggatgaaaagttcgctaagccgcatgtctggtcgctaaagcaagattttgtagttggcgctacggatgctgttaacgtcacgtctccaactacttggggttggttgattggtatcgtgttgttagtattattgctcattgctttaatcatattctgggtaattaaacggcgtcaaaataagcgctaaggggtgatactatcaaaaagctaagagcaattgttgtcatattgatggtattgttacaagtcatagccgctggtgcaacggtaagcttaggcgccgatatgaccgctcaagcagctacgttaccacagttaacttttgcaaaatcaacggctagcgataatattttaacgaatcaacattttgatgttgaactacagattggtgatacggcctctaaaataaatacgattgatttaccgaacgaggttaatttagatgggccagaggagtttaagcaaataaaacgagttttcgatgatagttccagtacacaacggggataatggcgcctttacaattacggctaagcatctgacagtttcgtacaatcctgataagcgcaggataacggttcagtggtcagatgaatatccgcaaacgaaggtaccaattagattaacagctgttaaagcagaaaaactggcgttagttgctgtagccgatgatcaaaaagggccggcgttgaatgtcgagattaagcaaccacaaacgcaggctgatcaggccagtacgagttcagctagttcttcagcggcaaccgatacaaatagttcgacggcatcgtcaagtcgacaagcgacatcatcagcagcaagtttggacagttcacgttcagcggcaacgacgctttcaagtcaggcggtaaaccaaacgagtgctagcagtagcgagccttcacaagaaactgctgctaatcaatcgtcatcggtcacggaatctgcgggtgagacaactgatagttcggccagcatctcatcgtcatccactgctagtcaagtgttctcatcagcaccaactaagcaagcaacggcgagtgccaaatctagtccattaataccagtcactcgtttagctcagctgagttcgaatgtggttgatgttagtcagtggtctcaattagtcgatgcttggaaggatgcgagtgttgatgaaattaatattacggctgatattagtaatccgactgccgcttcaggtgctttggattcacgattatccggtaatattattgtgaatggaaatggtcatagcgtgaatattggtcgggctggttttcatacccgaaataatactgcaactagcggtacgatgtacacggccacttttatgaattttgcatcattaatcggatcttttggaaatgatgcgggtttgattggctcatccaccggtggcgatggtgccggaggggctttgaattggacatttaatgttagtaatattacggtcccaagtgggactagttataccaatacaagtcggctgatttgtcagtgcgcaagggaaccaagtcaatattaccggcaattgccgagtaacaacggttcgagaaaacatcttatgtggtggccttgatgtagctgctggacagacattcactggatcgaaaatagccaatggtgatgataattcatttatctggtttgtttatgactatcaaggaactggtaatcggcaagttaatgttgaagaaggcgcgacgctaaattgtattcgacgacccgctagttctacgtcaaccgcctatactacctatccggttatttttgatgcgtatgaaagtattaatgtgggtaaaaatgccacgtttaatgctagcgtgccaggaaatgcatactctaacaagtacttttatgggtcacaatatcatcgtaatttttacgcggatactggtagcaccgttaatctaacgtcactagctagaagtcaatcgccaatctctttttctgataatgcaacttcgacgattcaaagtagtagtggtgcccaatatttatgtaattgctgctacgggagcaccgcttatttcgggaaattacgcgcgtttggctactgttcgatttattaatccgaacaacttggatttacgtaatagctcaactggaacgactgcagcggctagttcgattaaccaagataatgtgggcacttttgaaatccaagatagtaatattagcttgtggaaattagcatcatcggttacgggcggtgcggattattcgtatagtaacgtatctcagttattacaacagggttcagcagtgacggccacggatagtaatttgcaaagtaattatttatcttctaaaatgcgtcggattagtgccactaaccagaagccacaattagcatttaataatccgtatgatgggacaaccaagctaacagatgcggatcagaagctgcggacgcgagtcattgtggcgatggttcctgatactaatggtgttcaagatgacggaacggttaattatattccacagtatgctagtgcggggcaattaaccgtgagttatagcgttaatggtaaaacaatcactgcccaaactgatagtaatggctacgcaacagctaatgtcgggacctttttaaaagctggaacgacggtcacagcatcgactagcaataccagtggaacgacggtcacggctaccgggacggtggttgatgtgacgccgcctaatccggccacaatggtatcaccggaccccattagagtttcaacaggaacggtgagtggtcaaaatggagagccaggtgtgcgaggtcacattagcattgaatgggcagattcaaactaatgtcaaaacggttgtcaatgccaatgggacttggtcactgaacttaaccggattatcgttaaaaattggtgacaagattattatttatatggctgatagtctaggaaatcgtaatcctgatcctaatagttatccaaatgggcagcagtatcatgatgcgactttccaaccagcaccgatatttacagtagctaaggatttaatcgtcaatccaattgatcctgatgatcctagcaagcctgggactggcgggacgaacaatttgggcccgttatcgttggacgctgtacctacacatttgaactttggacagcacagcattccaacaatggatacagcgtacccattgttgtcaccatcagccgctgaagaccaattggctactgctactgatggacagaagtatgcaacagttggtggtcagaaaaatgggcgaggatagtgtgtatacacaagtgactgatacacgggacaccccaagtggttggcaattgacggcccaattatcagcgttgacagctactgatgggacgaccatgacgggtagttacgtgacgttaacatcaggaacagcgcaatatttgaatgctagtactagtaaatgggttacggcaactgaccaaaatcaggcaaccttaccagccgtgattaagttaaccccaggtgctacccaacaaacgttaatgaatagctgggacgactagtcaacaaggcgtcgggactaatcaacaaatttggaatgttaataacgttgcgttgcacgtcaagggtggtcgtgtgatggctaaaaattattctggaactatcacttggcaattgaatagtttgccaagccagtgatcgttatttaatggtatgcttcaaggcttaaaaagaatcggacgacaaaactgattgcagttttgtcgtccgattttgagtatccgagattaataattagccaaagattgatttgaaaatagagctgaagaagttaacaatcgcgctccacattttttggagcaagttttgattttctttagtattgagtttgctgaagacacccttggcatttgattgaatgttcttcatcaacgagttggcttgagtcttaaagcttgaagaatctaatgcacctgaatcacggatcttgactaacaaattaataatttcagtcttttgattattagtaatgacatttgttaaatgtgttattggtaatttgttgattgacaatggtcgtgatttcgtttttagtgatgttacttcctttttgggccatttcctttttggcaccagccacagcgttgttcaactgggaatcagtataaccatccttgctcttatttgcttgggtgatgccactgagagtacttaactcatcttgggcggcggttacttgcttcgtgtttaagctgttaccagattttgcgtacgctgcgtaaacaccggctagtgcgcccgaaccgtcgattggagtagctgatgtgacgtaaatattagcatcggtaatcccagccgttagtgcggcgtttttatactggttagccgtaatagtggtgatgttattactaccattataatttaaaattttgacattaattccagaaccagaacttgtttttgaatcatcgcactggaccacacacctgagctacttgtgaaactttcaccggatgggttgaggtatttaactagagtatcgccgttaacagttagcgtctgataatcggcaccgttcaagctagccgttaacgtgttgatcgtcccagtcttttgactgctagtcaggctactgcctaatgtgacaattggttcatcgctgctactgtcagcgtgcgcaaggacttgccagctgccaagcccaacgatcagggtggcaacgagggcaacccatttaaatttgaaactcattcgtttcgtcattttcttttcctccgcatcttaactaatgcacctaaatcctaacatgaaccgttcgctcccgggttgtacagtggcaactagcgattgcaaggttaggttatgtcattattatagcagaccgtggtcgtaagttaacattcggcgcgtaaccttgggagagtcctaagtattttaacaatttgtttattatttgccgaagtaccagactttcgctatactcgaaataaatatcggggaggttataacaatgacacaaaatcgggtgattaacgcgttgagctatttaagcattttattcttaccagttttatttccattaattgtttggttgctgacgagtactaatccggaagcacatcgggttgcaggacgggctttttggttacatttgttgccgacaattttaggaattacactgctcgttattttaggcgttagcggtatttatatggacagtatcgttaatagtggctggttggccgtggttcttttagcggtatttggattagtcgcagtggctagctacttatggtcgattattcgcggaattcagtatttaattgctgattaatgtagtagcgttaggttcaggagggtttagcatggttgttaaggacgcatcagtggttgaaacagcaatgatgattcaattttggcagcgtggttattatcaaacgacagttgacgacttgctcaccgttagccagttgtcacgaacgcagttttatcgccagtatcacagtaagcgggttgcgttacgccgttcacttgaacgctatcgaaataacgttagatgaacaacttgatcaattgattcaacgtgagcgggcgcggcaaacaccattgcccgctttaattgcggcttgtttgcgactgccgtttcagagtgaacggtggccagcgggatgtttgatggtgaacctgatggccgaaattgggtcgcaggatgcgtccttgatggcccaactgcaaacgatctatgctgatttacagacccgactcgtcggtttactttcacctcaggctaaagccttaccgaccacggtcgctgaggctgcagcaagtttaataatgggttcgcagcggcattcagttattggcaaaacaggatcctagtggggcacagctaaaacaacaggcccaaacgagtgttaatctgattatgggggcagtttaagatggttgagattaaagtcattcacggtgatattaccaaaatgaccgttgatgcaattgttaatgcggccaatacgagtttgcttggtggtggcggcgtcgatgggtgccattcatcgggcagctgggccagcattgctggctgcctgtcgcccattacacggttgtgcaactggtgaagccaaaattacgccgggctttcgactaccggcgaagtatgtgattcacacgccgggtcccgtttggcaaggtggccagcataatgaattacaattgttagcgaacagttatcgcaacagtctgaatttggccgctgagaatcattgtcaaacggttgcttttccgtctatcagtaccggcgtctatcactttccgctatcaattgcggcaccgttagcgttaaaaacgttacaagcaactgcgcagacaacggcccacacggttcagacaatcacgattgtttgttttgatgaccaaacgcaaaatgtatttagtacggcgttggcagcgctgacaaattaatctttaccaaaaaaatacacatggacgctactatcttgagtagctgcttgctataatgttgatataccggccatcggggatggtctgtaaatctttatgtattgggattatcaagcgataatcattgccaacaagaaaggaatccattgtgttagatatttttaaagcggtaatcttggggattgttgaagggattactgaattcttaccaattagttcaacggggcatttagtcctagttgacgaatttatcaagatgcaacagtccacgcagtttacggatatgttcaacgttgtgattcaattaggggcgatcatggcggtcgttgtcctgtatttccataaactaaatccgttgtcaccacgcaaggataccacggaaaagcgaaatacttgggttctctggagtaaggtgttattagcggtcattccatcagtgatcgtggggctaccgttaaatgattggatggacgaacatttaatgaattgggcggtcgtttctgccacgttgattatttatggggtcctattcattgtgattgaaaatcataataagcgcttaacaccccgctttgctaatctacaaaacgttaccttatacgacggcattgttcattgggtgcttccagttgctctcgttgattccagggacttcacgttccggtgcaaccattttaggggctatcttgattggaacttcacgctacgtcgcaactgagttttcattcttcatggcaattccaacaatgtttggggcgtcattactgaagcttgtgaaattctttgctcacggtggttctttagctggtttgcaaggagcagtcttagccgttggggtgatcgtgtccttcatagtcgcttacttgtcgattcgtttcttgttggattacatcaagaaaaacgacttcaaggcgttcggttggtaccgaattgtcctggggtacttgtgattggctactttacgttgattcattaaatactagaagcgtcacttttggctaagcttgttgccgcaaatatcatgaataaataaagtcagcgactataaattagttgctgactttttagattatatcattctagtaatctggatggaccgtcataacgattggataagtgatagaccaatcgttatgacggcttttttgaagtaatcgtgttaccgatgaactaatttatagttggttacgccgtacctttgattgaatgtgattctgacaatttgtccgcgtttgaatggggctggatcagcagcaactgtattaaaatgaagatactttttttcgcccttagaattagttgctagtccttggtattgatacccagtagctgagacattgaccggtagtgtaattggggaagttccggtactactcgatattttcatgtagtagtaatgaccgccatatcgaaaaataaaccaaccaacatttatcagaattgtgattattaataataaggtgagcagccattcgatgagatgattagacctagtattcattgtagtattctcctcgtatactaccttttaaggcttcgcaaccacattgaaattgcagctgtagaatcgtaattaggcagtattttaattgaattgaattttcagttttgaaaaatattaatgaaggtaataattttatgccaatcttaccaagggtatttttctttttctctaagcttattttgtcagtatctaaataataaattgagcttttctccctccaagttagaaaatctcgggttaaatacaattattattgtaaatgttgcgggcttataagcccacaatttgaactatattagacctattaacttacttttattgtaagtacttagtaaaaggcgttatctatttttttgctaatcatttaagaagtctaacagctgtaaatcaagataacgtggtgtcattttgctaaccgacaaagatgcactagctgattttcctgattaaacaaagtgtaaagtaatgcgattgataaattcagcgacgagaaagccaattgcaatcacgccagcaataatgacaacttgtacaaagtactggtaggccaagtctggttgaccagtgaccaagttacgaacgactaccgataagactggccaccaggaaccagtgggaccagactagggatattaaagatgatcatcggcattcgtttgtagcgtgcggccataccgctagcgacgccaatcacgatagctgcgacgaggttaccaatcgcaagtttggcgtcgattcctaatggcaggatgtgatagaggacctcatacgtaaaccagccagcagcacccacccaaccactgaggttaacggcgcgacgcggaatattgagaagtaccccaaaaccagccgtagctaagtaagctaagataatttgaaataaaccggttgttaagagccaatgtagcatgtcacgcctcctttagtagaaaaatgaagtcagtgcgataccaacaccaatcgcacacgcggataaaacggcctctacagcgcgggcgggaccactcagcaagttacccgtcattgtgtcacggacggcattagtaatggcgacacccggcactaatggcatcacagcgccaattaatgatggcgtcgggatgataatgaccgttagtgagataaaagccgagtagggtaattagaccaataataaaagcgcccataaattcgctgagaaaccgaattgaccccagccgattgatccaataaaaggcagcaaaaccagccaacccggctagcccacaagtaatcaagtcggcgggagttgtccgtccagtaaaggcgaccatcaacggcacactaacgacaacggccgctagacataaccagctgaatgggaaggtcggtacggcttgattgacccgttcgagggctgcggcaaattcagttaaatcaatatcgtgattagcaaactgccgtgacaggctgttgacctgatccactttttcgaggtccataccccgattatggattgctcgcacttcgctagtggcattttccggcaaggagacggtaatccctgttaacagtacgaagacacgcgcgtcagggtagcccgcgttggttgcaattcgttgcatcgtgtgtcttcaactcgtttgatttcagccccattttctagcaaaatggcgccggccaataacgtggtttttaacataactgccgtatcgctcatcaaaacccctcccacatcagaatgtttatattttctcacgaattttgcgtatcgtcattagtttggaacagaatgtttgccggaagtggtcggttatgggtagaattatcttaacaaataaattcttggaggcatttttgatgactgcattgactaaactcaccgatacgtacacgttaaataacggcactaagattccgattgttggttttggaacgtggcaaacacctgatggtcaggttgcttacgattccgtattagccgcattaaaggcggggtaccggcacattgacacggcggcggcctatggtaacgaggaaagtgttggtaaagctattgccgatagtggtgtggcacgtgaagacctatttgtcacgaccaaattatggaatgccgaccatggctatgacgctgccaagaaggcgctggatacctcgttggctaagttaggtttggactatgttgacctctacttgatccactggccaaacccagccgcaatgcgcgacaattgggaacaattgaacgccgatacttggcgggcaatggaagaagcttacacggcacgtaaagcacgggctatcggggtttctaacttccgtcctaagcatttagacgcgctgcttaagacagccaaggttgtgccagccgttaaccaaatcttcctcaatcctagtgatatggaagatgaagttgtggcctacaaccgcaaacatgacattttatcagaagcttatagtccattaggtactggtaagatcttcagtatcccagaattaaagacgttggctgataagtatgataagagcgttgcccaagttgtgctacgttggtcattacaacacggtttcttaccattaccaaaatcagttcatgcggatcggattaaacaaaatacggaattatttggatttcgaactcagcgatgatgatatgaaggtcattgatggtttccacggtgttgccgggttagctaatgatcctgatcaagttaatttctaagtttcattgttattaaggatgcagccactggcagcatcctttttatttatgcctttaggcccggttgagtgcgctaaagcgtgcgaaacaaaaaaccacccgctttgcgggcggatggcaaaatggttaaactcaaacgcccccatcagatttagaatgtaggtgtcagagccaaacattcaaaatcgaaaggggacgtcagaaatggcgaataaactaaacagccttgcacataccaagtggctgtgtaagtaccatatcgtattcactccaaagtataggagaaaaataatttataatcaatatcgacgtgacttgcaagatgatattcgcttgctatgccagtataaaggcgtaaagatattggaaggacatatgatgccagaccacgtccacttgttggtaagctcatcccacccaaattaagtgttgccagttttatgggttatttaaaaggtaaatcggccttgatgatgttcgaccagcatgcgaatttgaagtataaatttgggaaccgacacttttggtcagtcggctattacgttagcacggttgggcttaatgaagccaccatcaggaaatatattcgtgatcaagaaaaacatgatcaagcgcgaggatcggttgagtgtccgggaatatgaagacccttttaagggtcaaggcaagtaataacaacaccgcttaaagcggtcgcaaaagtgacaagagcagtttggctttgatacacaaaagccagcgccttgagacgctggctagtacatagggcttatagccctggagcaaactacccgttttacgggtagttatgatttggctaatcacctaattgtcgggagtcagctagttaaattagaaaattcgttgttatcgtaaaaagtgtggcgcggccgcttaataatatgaggtagaggcccctaattagactaatgaaacgtcataagatgtccgattgttgactagcaacctgactatcacagcgattggactatggtacactcagttttaattattaagtctgggggcctgtgaatgttactgatattagcaattttaccaattgttgtgacggtgggattaggcgtgtttgcggggctacgtcaccaatttgcgccaacgaccagtgatattttgattcagttggtcatgcattacgccttgccgttaagtcttttcggaggaatcttgtcattaaagcgcgctaccattattcaaaactcctcggtagcgctgtggttggcgctaggcatgctaggtggcatggttatcgtcattgtgagccaatgctgtttccatcaacaactagaaacggggacattacgagcgctagtgatcgccagtccttcaattccattcatgggtgtttccgttttactggtggtttttggtaaaatcagtgttttattggtcgcgttaggcggcctgtacatgaatttggtacaagtgccagtgagcgtgttgctgttaacgctagcgggcggttcgacacctgagcaacgttggcgagccggttggcagaaactgtgtcgtgcgagtcggcaaccagtcgtgtgggcgccaatcagtgcttttctcttaaatttggccggattgcggttgcccagtgcttggctaacgaattttacggagttgggacaagcagctgggggcgtggcgttatttgcgctgggacttctgttaacgactagaccgtggcgactgacgcgcatggttgtcttaaacgtgctactgaaaaatttaggcttaccggtgctcatttggggattatggctagtctaggtgtgtcattaagtaaccaacaattagtcgtcctgacgctcgcaatccccactgcaaccatcgcgaccatgttggccgtccaaaaccacttggcaccagatgagtatgtggcgacgcaaatgttagtagtatcggtcattgcgccgctgaccatgggattcttaatgtggggattgcagctcgtatgacgggcaccttttgattaccatgctgggtttgtgagacgcccacaaaggagggcacgacttgcggtcagtgctgttatgattcccgattgacaaaggttaattggcacggtttaacgacgatgctaaaccagacgttgtgaacgtcagtatagacaaacccgctcaaatagtgcatatttgagcgggtttgtcgcgttagtcttaatagtgaacttgaaaattagtcggttgcgttgcgttgacgacgggatgttgcgcaaagtagtcggcaattaatacggtcatatcagtaggtaagcgccggataatcttagctgtttgatacattgggtaattcccaccgccaccagcgcggtaatgattcagagtgaccgttaatttttggtcagcggtgactggggccccatgataatcgagttgaacgacacgttgaccaaagggtttttggtaaggtcgaaagtatagtcgatgccactgtaaatatcatagacatagtggcgcaacttagggtgcatgaactcgggattgacccgaacgtgtccgtcttggaggagaaagtaactcgcgcaacgttcaagagcggcgcgtaaatcagcaccagtaatggcttcaacggcaagtttgtttgggtagacgtaactgttcatgacttcccgcatcgtcacgtgttgtttgaggcctggtacgtcgtcattaaataatgccgttgcggcaatatcggtaccggttgcggccatttcaacgcgattaataaaatcgatgtaaggatgattatgcagccgtgcttgaagatgatcgtgtacgagcatattgccgttaatttggccaagtggtgtgtctaaccagtcttccatctggtcattgattggtccaactagttgcattacctgggtattggggtggcatctgcgaccggatagatttccggatgactggtcgtcacttttgatgattgcggtcgagctcaagggtaatcatagcaacattagtacctttcataccaggttgtgtcacgggaacaccgtgaaccgtaacggctaattgtcgatgctggtggccagtaatcatggcatcaatgccggggacttcagctaatagtgcggaacctcggttttcaccattcatgtgttcggttggacgatcagtttggggatcgcgttcaagaccaccgtggtaggcgatgacaacgacgtcagccagttggcgcaatttgggcacccaatgtttagcagttgcaaccacgtcctcaaagtgcgggccggcaatgtgatgtggttgttcccagtgggcaacgaattgcgtcgttagtcccaaaattgccactttaactccggcgcgttccagaattgtgtatggcttggagaataaggtgcggtgcggtcatcatgaatattagcggccagcatcggatattggcggcttgattcacacaggtcgaggtaagtcgagcccgtagttgaattcatggttaccgaaaataccagcttgaacgtggttgcaatttgcaaggcgcgagtataacggtgcagcttcttggtggtggcgagcaatgaaataggtcaacggtgatccctgtacgtagtcgccattatcaatcacgattggccagacatcagccgtatcttcacgtgacagttgatgaataacagtagcggcacgactaagactaaatggtgcgatgttatcacgacgactgtagtcagttggcgcgaggtaaccgtgcacatcactagttgagattaatttgattttcataacgtgcctccaaggaatatttgtgttctattataacaatattcatggctggtaacttgattttagtcataaattgaacagttttttgatgatgacctgtggttaatgtttaatggctgctttaattgtacgttctaatcttcacgactttttcacaatttgtacgtaaaacgacaaaatgtttccgcgctattatcattaatagtgacgaatgacaacgataatcgaattacggaggaataaacgatgcagaattatcagaatgcaccattcaaacctacccccgagtccggtttaacgaccacagcggtgacgacccagctaactaaattcggcaaaaatgaattagtagctgcgcgccccgtaccgttatggcgtaaaatttggcaacatatgagcgacgtttcatcgctagtgttattatttgcagttggtttagccacgtacttggctcttgcccagaatgggggctggacaaagaccattgtgattggcgccattttagttattaatgtctgtattggtttgtaccaagaagcttccgcagaaaagtcgttggcggcactgaagtcaatgagtttacccacagctaatgttcgacgggatgggaaggtacaaacgattgcggcaccagaaatcgttcccagtgatttagtgctactaaaagcgggtgaccaggttccagccgatgcggtcgtgttagaggccacgaacttagccgttgatgaggcagtcttgacaggtgaaagtgaagctgttgaaaaaagtatttatcaggacaccggtgagttggatgataactgtcaaatgtatgcgggaacggccgtcacagccggtactgcattgattcaggtcttaacgaccggaatggccacagagttaggtcaaattgcgggtttgttgaacaagacgaagcaacgggccacgccattacaggggcggcttaatcggctatcaagctggttaacgacatttgccgtcttaggtggtattacgatttttgcgctgagtgtttgggtgcaaaaccaaggtttggccgatagcttgatgattggggtttcattagcggtcgcggccgtgccagagactctgccgatcatcgtgaccattagtctttcacacggtgttcgacggatggcagacagaaatgccatcatgcgccgagttagtgccgttgaaacgattgggagtgctcgatgtaatcgcgtctgacaagaccggaaccttgacgcaaaatcgaatgacaattacaaagtattggacgccgaccacgggcattatgacgaccgaacagcccttgccatcagcgggacaaacattgatgcgttacttaggattagcgacgaatgccgagatcaaccacgttgacggtgaagaacaagctattggggacgcaacggaattagccgttattcgttggctggctcagtatgatttagatcggcccagcttggaggcgcagaccccacgaattgcggaagacccgtttgactcaactaagaagatgatgacgacggtgcatgaattagcgcatggtcgacggttagttatcgtcaaaggggcttgggatcggttaccactgaagcctgaccaagctagcctagctgctggacaagtggcccatgatgaatttgggcgggcggcgcttcgcgttttagctgttggctatcgcatcattcccgcggatgtccagaactactgactgggacgacctgacagctgacctccaattggcgggattgattggtttgattgatccaccacgaccagaagtgattccggccattcgagcagccaaacaggcgggtatttttccagttatgatcacgggagatcatttggttactgcgaaggctatcgctgaggaaattggcattttaacctctgagctgcaagcaattagcggtgatgagttacgccaattgagcgatgaagaattgacggctcaaatcgatcagattgcagtgtacgcccgagtgtcgccgagtgacaaaattagaatcgttcaggcttggcaaagtcttggtaagacggttgcgatgaccggtgatggtgtcaacgatgcgccggcattgaaagcggcggatgttggcattgcaatgggaattacgggtaccgaagtatctaaagaagccgctgacatggtgttaacggatgataattttgcgacgatcatggcagcagttaaggataaggtcggacagtttatcagaatatcattaaagccgttgaattcttggtaggtgtcaactttgcacaaatcttcttgatggttggtgcagtcctcttcggttgggggcgccactgttagcagaacaattgctgattattaacgtacttgctgatgggattccaggattctttattagccaagagccaggtgaaccccaagccatgcaacaaccaccagtagccaatgacgaaagtattttagctcggggccttggtcaacggttgtttatccgggcagctacttttaccgtactaaccctcggaatttacgcgtttggccgctttggcttaacaaatggtcaagccccagtcgggatgacgatggtctttctagtattggcattaggatcaatgatcgacatctatgcaattaaggatcgccgaccactcagctggccaagcatgatgcgtaatccaatgctgaaccgaggattgctgttaggaattctggtggtcttggaacaattgcagtgataccaccgttccgtagtttctttagcttagtgacactaccagcgttaggctggttaacggtgctagtagctacgctgattccaacattcgtgctggaattgaataagcgctggcgaggcgcggcgacagtcacgattagtcgtgaatactgctgaataaggattatcaattcaagttagttaaaatgctgcttacaaacgttattcgtttgcaagcagcatttttcgtgtcattaagttgtgtgcctaaaatactggccggtgagcgggcttagaacgtaagtcatcacaattgtaggcagataattctttcagaccatctttactagcatcgaaataggccgttaatccttgggcaatcattaagttgagttctttattcgcatcaaactgaacgacgatgacgggtgtcttttcagccacggccgcaccgatttcaaacattgtgccagaatctggctcattggttgcactagtcatgtcgaagtcaagaatggcaacaacgacatcggcccgatgaacttgacgcatatcggatgcgtagacgtattgttgccaagcacggctaccaaaaggttcttcttcaaattgatgttcttctgggatgaagataccatcggggttgatcgtcgggttagccaacagcgccgacttcacttgttggatgcgttccttctgagcctcgtcaaaaaacggtgcagctaggtaaacgttattcataatgatttcctttctggataacaaaatttggataagcctattttagcggaaatatggggtggctttcaagccttgatttggcgtgaatcattattaaaaggtgcttatttttggattgctgttcgtcagcaatgatcgtcctattccgacctccggggctgggtgacaattgctggaacgtaagccgacgtcgatttgagcccgtacacaacccgcccggtctcaaatacgagtcttattctaagccggaagcagaccacttccgactaagaataatttggctactgagcattgtcacccagcccctccagtctcaagcttgcgaggggccacgggttgaagccgagcattgccgccaacggattaatgcggttttggcattagtccattggcgtagcaagcacaggctttagtggcaccgaacacgtttcggtaagccgctcgaatggctgatgaacggccacttaacttagcacaatttatcgttgactattttgatattaaacaaagacaaagggttagggtgcactaggcactctgtcaggagtttgaatcttactatgccgattcaggattaatgagctacctcaatatcattttcagtttgacagttgattaaccaaattactgtttacaaaaagcaacggcaaattcatcaaaagttaagtacagcttcgtctgccattcgaatactctcccgactggaaggcgtttctgacaatgcccagtggtgaaatttcacttagcaagtgtccttgtgcttggttattgaaaggccagtatttgagacgtgatttttcggctcaagtctgtgcccaccacgttccggcaattggcagaaatgcctggaagtcggtgtaggacgaaccaaccaagcatgtttacgctgattcgaactttttccagcgggcctaagctggctatttttgaactttcaaaataagcaccttttaataatttttgaggcgaataataattagcagagtggatatgtagattataattctatttataataaggtaacaattagatattgttgaattaaaatctaaattgggctaaattaaatagggtagtgaggaggattggatgatggaggaatttggatcaactagtaactatttactttcgtgggaagagttgcccgcggtgcccgtttatatggaacagttgttgcaacttgttaatgaaacaattcagccgctggggttacctgccgtaacgaagacgatgattaatagttacgtgaaacaacattttttcagtcggccggttggacatcggtatacccggaatcagattgtggcggtactagtcgtttcaattttgaagactgatttttcattaccagtaattagtaaagcgattttgcaaattcgtgattcgcgtcagattgagccgcggtaccagcaatttcggcaagcattcgagtctacgcttgctggacaaccggtcgtcttgtcgacggttgtcccgttagcacgggcaattcaattagcagctcaaacggtggcggcacatttattaacgatccgagcgcttaacgaattggtagattgagttgagataggcacataattgagaatagcgtttgataatatcgctatggctgcttgtagcgtattcgaattaaagcgaattaggcttagcagatatgattaggtatgaaagagagaaagagaatatgacaacacgcaaaaaaatggacaattgcgctcattgcattcttgaccgtgatcgccattggggtctcgcgggcggtagtttttatttatatcactttgcatttgaacccaccccgaaagttttgaaccatagttctagtaagagtaaaagtaagttgaagcagaaccaagcgtggctgaaacgggtcaacaagcagacctggcatgagacgtccgcaacggatcatttgaagttagttgcggactatgtaccagctgcgcaccgaaccaccaaaacgattattgtggcgcatggttacatgggtaacaaggagcagatggcgagctatattcgattgtggcatcgccaaggatataatgtgctggcgccggatgatcgtggcaatggtcagagtcaggggattactatggttttggttggcctgaccggttggactatctaaagtggacgcgacaggtgattcgccgcgtaggccaaaatagtcagattggactctttggcgtttcaatgggtggtgcgactgtcatgatgatgagtggcgagaaacttccatcacaagttaaagccgattattgaagattgtggctataccagtgttggtgatgaattgggatatgagctgaatcaactatatcacttaccgaagtttccactgctgtatacggcaagctgggtagctcaagcgaaggcccacttcaactttatgacggcgagttcagtaaaccagctcaagaagaataagttgccaatcttctttattcatggtgctaaggatacttttgtccccacgaagatggtatatcagaactaccgcgctacgacggtcaagtcaaagcaattatgggtggctccaggagctggtcacgcggaatcatacacgcgttatccgcaactatatcaacaaaaagtaagccagttcatggcaaaatatttgaagtaagagctaacggaatagaataactaataaaggtcaccaagcagcgattgctgattggtgacctttattatggttaaaatatgctagtcggattagtgtttgtcagccggtccgcgtcctggtccgatctccgggactaagctgatagcttttgaacttgataaatagcgcggttaatcaaccgagtgttttgcaaatgggtgccgcatacttggaataaagatcagtacgccgatgaagttaagcagtaatgacaaggcggtgaagataaagacaccgttgtaatcgaaccagccggagacggcgccaccaagtaaggagccgagcatgctgccagccgcttggaaagattgattccaactgaaaatagtgcctgttaactcgcggggtgtatttttggataataatgtttgcaccgttggaaagagggccccgtcagagatcccaatcatgaagcgcaatagccctaatgtccacacactggagacgaagccttgtggaaagtacatcaggatggcaaagacgaaaccaaagacaaggatacggtcagcccccggtgatcaccgagccgtccgagtcgcggcgccgataatagcgtcgaaattccgggtagagcggcaatgattccctagcaacgacggtgattggaccgacgttatgcatcagttctttgacatatagactaataatgggcgtgatggaattattccccatttgaataatcatcgtggagacgagcagtgtgataatcaacgttggatttttaaattggctgagtagactgccgtcacgtttagcaatcggcgcgtcgctgggtttaaagctttcgtggacgagtgtcagactcaatacgaagacgatcagtagcaaaattccggtgataatgaaagtcaaacgaatagagaaaacttgggcgagtacgccaccgagaatcgggccgatcaagttaccagacacgtagccagttgttaggataccgattgcggtcccactactttccttgggagtttcggtggcgattagggcgctagcattgggaatgtagccggcacacaggccttgtaagaaccgaagtagaatgagtatccaaatgttatggacaaatcccatcgcaccgataacaaaggccatcccaagcgaagaacgcagcagcatgattttgcgaccacgccggtcagcgagtttaccccataatggtgagacaacagcgacgacaaaaaagtcactgcgtatgtaataccactatacatcgtgagttcgtttttggagaaatccccatttgaccaacgtataatgataagaatggcatgacttcagaaaatcccattccggcgataaatgttcctagccagagaacagcgagattccggcgccagcctgtcaatgcgcccttcacaatctgtcacttccttaattaacttattaagattattttaatgcgaatttaagttttgtgcaattaactaacttagttaaatagacttgaccaagcgtcactaaaaaaactacaatggaaaacattgtagaaagggtgaacgatgtgcagcaagagtcaaagtatcaaatagaagtggtggcgcctaagcaccgacacatgtctaattgggacatgtttgcaacttgattggcggccaatgccaataatggcacgtggtacgttggtggtgtattggctgcgtgtggtttattgacggcgcttaaagtgattgtagcatcgtccacgctatcgtatttatgtttatcgttagtcggcttcatggggtataagaccggggcggcgacgatgagcttgattcgtggttcctttggtgtgcggggcagttacgttccgtcctttgtgaacttgacccagtatattggctggacagcggtaaacacgttcattgcagcaacttctgtcagctatttattacacgatctagttggctggccagtctatggtaaacccggtggggctaaaggactgatcctcggaattattgtcatgagtgtgttgcatttattgagtgtttcggtcggtcaacggtcggttcagatgattgaacgtttaggtattattcttgtcatcttatttgttttatgggagacggtcgtcgtgttccagacggtctcagtgcatgatttgttaacgtaactgtggcgaggcgccgacacatttacatatgacggcgggggctgggatggatacgctagcggcgttcaatttgtcttgggtgacagcgggtgctgattttacgcgttttacgcgcaaaaagagtggcgcgactggcatgccatttttaggggcctttaccggcttgttctggttcgcctttatcgggcttgccgcgacgatcagtatcgcgattacttctggaacttatgatcctaataactctgacccgagtaccattgcgagtcgactaggcttgggggtattagcactactggtgattgtcttaacgagtatgacggcgaacgcggtaaacttattggcggctggttcggcgctgtcgaatatcttcccacggattcggttacgaccagcactgtgggccgtgacaatcattgccacgttagtcacactgattccattaatcatggggagtttttagctgcattcacggcgttcctagattatattgggatggtgcttggaccgatgatcagcgtgatgttagtcgattactattggcggcatcgtcagcactatgatatcaacgaactggcgagctctaaggggcagtattggtatcatcatggggtgaattggattgcgctattatgttgggtactaggtgtggccatcttcttgttattgaagcacattgcttggattgcgacggtgactggtgcaaccttcattgacatggcgcttatcggggtcatttacgtggctttaatgcgaattttctacccgttaccgccaaacgtgtctaattggattacaatagataagtaaacgaaattagaacgaggggtgtcatgatgtttaaattaactgagatcgatgacgtattaaataatttaggtgaccacgcagactttgccacgattgccaaaaaagaagccgatttgggcgttcaacattttcaatatgatgttgctactggtgccacaacttactttggtgagaacggttatctcgtggaacgggccggacgaatggcttagcagtccgggtcgctcgtgaagaagatgccgcggcagttgaacaaatcgcgaagcaatatattgctggccagctggctctaacagacgctgtcaagcagtttgccaaggctgggtgtcaagcttggactgctaacttaaaacgccacattgtcgattttagcggcgatgaaggtaaaataatggcagctgtaacattctaaatcaataataaagtgcaaaaatgcagactatccacttttaaccgggtagccctgcatttttgcgttccattaagtttaatagccagcttgatgatattgcttgcttaactggcgttctaagctaagtaaagtcagcggacttagccgccgtaactgatcagagtgatagcgcatgactaattgttcgggactattgattgtaatactagtgacgccgtttaggccttgaaaagcgctttgaatggctgctggagctcgggatgttggggccagacaggggaggactcagcataactagaccatgttcaggatgttgatacgtgatctgatatttgttgagataacgttgaaacatgtcttctgggttcatgagcaattcctcctcggattggttactagtaacggtgagccgcagtttagtttataacccaaaccagacgacccaaacaaaaaaaagccagccaggcacaatagcgcaataccaatcagtgcccagatcgtaccgttcagctttttggtgtggtgatagtagtaaatactgagtatgccacacagtatggcaagaatgatgctggtgccaataattaaaccaattgtcaattccataaattactttcgactcctcatattatcattttaattgtgcattaaaatgcgataaagtgcaattatttatcaggattcttagtatggtaagaacgctaagcattgcatggtgactgagtagtcttgggtggcttgctgatgagaagccacccaagactacttcaatgataatcgatcaaaataaaaaaactaggctgcttatgattaacagcgctagttttgattaatgacagttagtcagtcgtttttttagacaaacgggttgcaagcaacaaaccggcgagcgctaaaataaacgtaaagtagaacccgtaatgggcaccgttgacgaacgcgctagcagcttgatgacccccattggcgtagtaagaagcttggccaatgcctaataagctcgttgcaattgcggttgaaatggcaccaacgacttgctgtagtgtgttcatgattgtactaccatcggcggcaattggtcccgttaaggaatttaaaccatgcgtctgtgaaggggacatcgctaatggcgccccaatcattaagataacgtgggccaaaataacgtaccacgttgcactctgcgtggttgtcagtgccaacatgagggcaccaaccattgaaatcaagaaccccagcattgctggagtgcgggcgccaatcgagtcatataagcgacccggagagacggccgatacaattgcgttcatcaagccaccgggtaacatgatgaccccagtcaatgcaacgggaatcaacagccccttttgaatgtacattgggagtaaatacatggctgataagataatcccaaagttaatcataacgaggcaagcgccaacccgaaaaccagggatagcaaatgtcttaaggttcagaattggcgattccatggtgagttgtcgatgggcataccaagccagaataaccagtcccaaaattaaggcacctagtacagcgggcgacccccaaccttgatcactagcaagactaacgccaacaacaaggctaccaaagccaaccattgaaagtaaaatggataagaagtccactttcggccgggttactttcgcaatgtttttaagtgaagtgacggcaaagataaaggcaataatcaagaatgggataaagagccaaaaaatccaccgccatgaagctagtcctaagatggctccagcaatcgttggacccacggccggtgcgaacatgatgactaaaccgaccatccccatagctgcccctaatttgtagggtggaaaaatctgcatagccacggtaaacatgagtggtaagatcaggccagttgcgataccttgaatcattcgaccgaataataacacgccaaagccaggcgctgaagccgaaataatcgcaccaacggcgaagtcaatcagggcaaataaaatcacttggcgggtcgtaaaccatttggtaattaagcttgaaagtggaaggacaatcccaatcataagcatgtaaccggttactagccattgcacagttgccgttgacacgtgtagctgagccatcaattggggagggcaatgttcagtgatgtttcactaaacatcccaacaaaaccaccaattaacatccccatcatggctagcatgggatgggcaacgggaacgcgggcccgttgtttagcttgcgggctactttgtactgaatccattatattgtttcacactcactttcctgaatacaatgggttagcataccagaaaattatttttttcgtaagtgttttttctgaaaaaagaggattgatttacggtagtttgaaaaccatcactcaactagtgcgtctgtgactgcaattgtcggcagtttcattgagcgagaaaggtagcacgtaatggttgttaaaatagtgttttttatgtaaataggccacctcagtgtcaaactaaggtggcctattataggtggttgctaagcaaaatcaggtctgcaggcggatcagttatgttcaacaatcgttatgttttcatccaagcacgatggttacactttagcttcgaattggtgtccacattgggggcaagttatccgaacgcgaccatgatgacgcggaatccgaatccgttggtgacactgtgaacagcggaaaaagcggtattgccaatgctgcttgacctggtattttaaacggctgaatgggcgaacaatcggtgaccaaaagcgctgaaagccgcgattgatcgcaacttgctgataaatctttttagagaacaaacgccagtaactaataccgatgagcatcacggcaattaagagtagccacccggtgcgaatgaaaaaactgatgacgatcaatagtaaagcgagattgtttaaaaagcggtttaacgtatcgttttgaccgtaccgcccacgcatccatgatcgtagtcgctgtaatagttttgagtttggtttcaaatgctgaaccccgtcactaaaataattaatatttagtagcataacatagtttttcaatagataaataatacctgtttgtgccactaacggtgtatacttaagcatattacagtaaatagagggaaaaacatgtcaacacaatcacaaatcacgcaaacgcgggttctcgatgctatcagccgtgcggcactgatgttggagcgccaagacgcagcgcaaagcgggttacaactgttgctcaatgaatttcggcgggagagtttattgcagacgagcggacaggccgccacgacggtattgtatcacggcaaaatcaagagctacctgttacaacatccgagcaattatccagatagcgtcgcggcgttatcatcattattagatcattttgttgcggctcagtaattagggccgtttttttgcgccaatcaagttattaacctaactagtgatgatttgggtagtggttaatggcagtcaatgttgttattagaaagaaaattgcgctatgctagatggtgaaccatgcgagggtgatagttgctttttacgtttacgattgtaaactacagttaatttaattcgaagggtggtcaaaccattggaagcacaaactaaaattgaaatcagtgatgccgaatgggaagtcatgcgggttgcttggacgttgggcaatgtcacgagtagtcaggtcgctgagatcatggcggataagatgggatggaagacagcaacggtcaagacactgcttggacggctctcgtcaaaaaaggtgcgttacgtgctgaaaagaatggtcgagcgttcaattattatccaatggttgaggaacagccatcgatggatgaagccgtgggcaccctcttcggtcatttatgtcagatgcgcgttggtcaaacgttggtggaccttgttaaccaaacggaattgagtcaaacggatatcgccgctttacaggcagtattggctgaaaaagccaaggatgcgccagaaatggtggactgcgattgtgtgccggggacgcggtgttaatgtggttataaacgaatattgaaataacactgaatgtcatgtttggattttcttaatctgaacatgacatttttgagggaaatgatcttaaagatacttggctaactgaacatggggcattcgtgcgaggccttaatcggaaccatcagttatagtgcgcctaatggaagggacttactttcaagataggatactcagaaaacagatgaatggcgacaaaaagtcaagaagcagtgtttttcttgacttttatcgtctacaattgtaaactttagccataaattacagatgtagacaatccgactagggaggtcgctattatgaaagacatggatatgcaacacatggcgcaccatgattcaaatgacatgggcgatatggatatgggtaacggtgagatgatgcacatgggcaatctcaagttgaagttttgggtagcgttagttctgacgattccgattatcattatgagtccgatgatgggggtcaatttaccatttcaaatcgtttttcggccatggtccgattatatcgtcgcaattttaggcacaatcctgtttctatacggtgggcaaccgtttttcagcggtgccaaggcggaggtcaaaaatcataagctgccatgatgacgttgattacaatgggtatcagtgtggcgtacgtttacagtatctatgctgtggttgccaatgacttgttaaatgtaaaaccaatggtgaccgatttctcttctgggaactagcgactttgatcgtcatcatgttgttaggccactggatcgagatgaatacggtcatgaatgcgggatcggcggtagataaactagcaaaactgttaccaagtacggcacataagttagttgatgggcgggtccatgacgtggcaattgctgatctagctaatggtgatcaagttcaggtccgggctggtgaacaaattccagctgacggcacagtgttaaatggtgcgactagtgtgaatgaagcgatggttactggtgaagctaagttagttgaaaaacgcgctaaggatcaagttgtgggtggttcagtcaatggtgatgggacgtttgagatgaaagtcaccgggactggtgaatccggatacttagcccaagtcatgaagttagtcagtgacgcacaggcggccaaatcgtcgcaagaaaatatggcggataaagtggccggactcttgttctacgctgccttgaccgttgcaatcgttgccttatatcgtctggttactcgtgggcaatctggcgttagcactatcaattgcggtgacagtgctcgtgattgcttgtcctcacgctttaggattggcaattccattggtagtggcacggagtacggcgattgcggccagccacgggttactgattcgtaatcgggatgcgatggaacaagtcaaaaagttgaactacgcgttgatggataagaccgggacattgacagctggtaactttaaggtcgctgattatcaaagtagcgccgaccggctaactgcggacgcagtcttggcgatgatggccggtttggaaaatggctctagtcatcccttagctgtcggaattcttgctgccgctaaggaacatcagttaacccctaaggttagtcaggatgttcatcagattactggtgtcgggttaagcggcacgattgatgggcagacgtatcagatcgtttcggcagcttacttggataaacaaaatttagcctatgaccagtgcaaacgttcaatcgactggcaagtgccggtaactcagtcagttttttgattcaggagcagacagtcttaggttttgtcgctcagggtgaccagatcaagccggaagccaagaacttgatcgatagtttgaaggcccaaaacattaccccagtaatgctaaccggtgataatccgcagagcgcccaagtcgttgctaagcagctcggaattacagaagtgcatgcgggtttattgcctgaagataaggctaagctcgttcaacagtatcaggctgatggtagccacgttatgatgattggcgatggtgttaacgatgcccctagtctggcccgggcagatattggcgttgccattgggtctgggactgacgttgctattgattctgctgatatcgttctcgttaagagtaatccaaatgatgtggtcgatttcttggctctggcccggcgaacgacccggaagatggcgcaaaatttatggtggggtgctggatacaaatatgtcatcacaatccccttggctgctggtattctcgcaccactcggctttattttgaacccgatgtttggtgcggtagtgatgtcattaagcacggtaatcgtggcaattaatgcgatgacgttacgattaaaagactgatataaactgattggcgtaaattaatttgtgcaaatgtgtgtttataatgggtttagatgctagaataatagtatttaaatcaaggatgtgaaacccatgtgtactagtttaacgattcaaaccacggcgggtgatcagtttttagcacgcaccatggactttgcttttgaacttggtggtcgaccagtggcaatcccacggaatcaccattttgacagtgttaccaatgcggacggttttgatagcccgtatagctttgttggaacgggccgtgacttaaatggctatatctttgtcgatggtgtcaatgagcacggggtcagtgctgctgcactctatttctcgggacaagctcacttcgtactcagcagactaaggctggcaaggttaacttggcaccccacgaagttttaatgtggattttaggaaacgtgaagagcaccgctgaattaggcgaacggattgctgacttgaacgtgatggaagccgccgcaccactattgaatattgtggtaccactacactggatcattagtgacaagagtggttctacttacgtcttagaattggaaaatgacggtgttcactacatgaagaatccggtgggcgtcatgacgaacacaccagattttgaatggcatctcaagaatttgagtaattacgtcaacttacaacccggccctcatcctagtcgtcaatacggtgacatgacggtgaatcctttcggccctggaactggggcgttgggaatgcctggtgactatacgtcagttgcacgcttcgttcggacggtcttcatgcgtgaacatacggatgcagtaacgactgatgcagaagctgtcaacgcattatcacacatgcctgaactcagtggagattcctaagggcgttaagatgcaagataacgggacgccagattatacccagtaccgcgcctatatgagcatgaatgaaccagcattttacatgcaaccatacgcggatcagacgattacgcgggtcgaattgacaccagctttaatgacggccgcgcaaccgactgaatttgaattaaagacaacccaacagttccggttagcaaactaagttggaatatattagggtcaaaatatgaaagcagcaccgttagcattttatgctaacggtgctgctttttttgattctaggcagaatagcactttcaatgacctataataattattcaaattaactttaataattaaatggtggtacactatattatagtttagggatacataacttatactcgataatgattacaaataagccttgcattttctttctgaaagatataatatttactaggtaataatgattataaagtatttacggaggcatgacaaacatgaaaaaaaggatgtctttggcacagcgggttaatattttgcgagcaagtgtcatgggagcgaatgatggaattctatcagttgccggcattgttgttggcgttgcgggggcaaccaccaatagtttttcgattttaatatctggactagccgggatgttggctgggacgatttcaatggccatgggtgaatacgtctccgtgaatacgcaaaaagattcacaaaaaatggcgattactaagcagaaggcagcacttgccgatgattatgaagcagaagcgtcgctagtcgtacaaaaatatgtcaatcaaggaatcagtaaaccgttggcgcaacaagcaacccgggaaatgatggcggaagatgcgctgactacgacggtgcgtgagcgctatggtttcaatccgaaccagttcatcagtccgtatgcggctggtattgcgtcgatgattgcctttcccactggctcaattttgccattagtttcgatcacctttttttcccaccacgggtgaaggtgttagcaacggtgttggctgtcggaattgcattaatgattacgggatacgttgcggcgatgctgggtaatgctaatcgtcggcgcggaatggttcgtaacgtcgttgccgggttattgacgatgatcgtaacgtactttattggtcacttatttgcttaattaaagggtcaaggggagcgagcttatgcaactgacaaggacaaagtctgagaagaccaaacaaacgatggatgagaagttaaactcattacgagcgggtgtcttaggttctaatgatggtattttaaccgttgtgggggtgctgtttagtgtggcggccgccacgactaatcagttcacgatttttattgctggattatctgatttattagcctgtgctttttcgatggcgtcaggagaatatgcttcggtcagcacgcagaaggacactgaaaaagccgtggttgaaaaggagcggcaattgctgaagacggatttttgagggtgaattgcatgctgttcaacgccactatatgactcttggcgtgacggaagagacggcgatggcgattgcacgcgatttattaactaaaaaccattggcaaccgttgtcagcatcaaatatgatatgcaactaggacactatatgaatccttgggatgcagcgtttgcatcgctattctcagcgtcagcaggaggcgtcttccgttgctcgcgatgacgtttgcaccggctcattggcagtggccggcaacaattatcgcggtgtccgttgccgtggccttaacaggatatttatcggccgtattaggtaagggcaatgtgaagacggcggtgattcgcaacgtgctcgttgggatcgtgacgatgttcattcactactacgttgggacgctcttttaagtacttctgtcttggtcagttcggactagggattgtcaacagtgaaacaatagctaaccaaacggcacttgaagtacggtgtgctggaaacggcactcagtatgggcgcaaattgttaggatcggtacgaacttaaatagcactggggcgggcaattactgtagttacccgccccagtgctatttagttgagggcggtttccgtgtaattgcgcacaattagtaataaaagttcggatttatcgttgcttatagatgatagaacttgattatgataaagattactgaatcttcctaaaaacaacgctcgattttcagtgagttttaattaagtctcggtataatattgccattaattaaattgaggtagagcgaaattgaaaaatatgacaactaaccgttatatgaagggcatcatgtgggcgatgttggcctcgaccctgtggggagtctcaggtacagtgatgcagttcgtatcacaaaaccaagccatcccggctgattggttcttatctgtaaggacgttatctgctggaatcattctgttagcgattggatttgtgcaacagggtaccaaaatcttcaaagtctttagattcttgggcgtcggttggacaattagtggcatacgcgacagtgggattgatggcgaatatgtatactttttacatcagtattgagcgtggaacagccgctgccgccactattttacaatacttaagtcctttgtttattgtactaggaacgttgctgtttaaacgggaactgcctttacggactgatttaattgcgtttgcggtctccttgttgggggtgtttttagcaatcactaagggtaatattcatgagttggcgattccgatggatgcactcgtctggggaatcctttcgggggtaacagcggccttgtacgtagtcttgccgcgaaagattgtagccgaaaattcaccggtcgtgattcttggttggggacattgattgcgggaatcctatttaatttatatcacccaatttggatcggtgcaccaaaaattacaccaacgctagtgacttcaattggcgccatcgttttaatcgggacgatttttgctttcttcttattcgttgctacatagtctacagtacgcgccgtctgcggtggtcagtattgttgatgccgtccaaccagtagtgacttttgtactaagtattattttcttaggcttacaagtgacatgggtcgaaatcctcggctcgttattggtgattgtcgcgatttatatcttgcagcagtatcggagtgatccggctagtgattatttgtaatgatagttatcatttttgtttagttagggcccttgaataagggctcagcagacttgaccatttgtgaaatgaccaaaaataaaagctgcgtgtcagaattttaacattctgatgcgcagcttaatcataatttgagtagattaaagttatcttggggacgatggttggtaagttgtgctacgccaacaccagtttccgggcgggggcgtgcattttaataacttcggcacccaggtcaatataaggctgaccttccgcaatcaatccgaacttctcgtaaaacttctgggcgtgcgtttgggcatcgatttcaatggtggcggcgctgtaatgcactttaagaattgccatgacgtgattcatgagttgcttgccaaggcccgtcccacgatagcaactgtcagtcgttatccggccgaacgaaacgaccccagcatgttcgtaaattcgtgcataagcgacgagttgcccctgatcgtaggcgaagacgtgacgcgcgtccaagtcagtatcatcagggtcttggtaagaccgatcttgttctttaataaaggtcttggcacgaagttgataaatatcgtgcagttgggtggtggttagaccattaaattgcttaacgtaccatttcaaattcaagtgaaagcctccttgaaaactgaagaatatcgccagttattttcaaattgagtctataatttaacacttgtatttttgaccgtcaattgcaaagacccgcgatttatcaatggttacaggtattacttttgatgaaaaaaacatgagaacggattgctggttataccagtgaattgatagcttgattgtcagtcatcgttagttaactgtctagatattatcatttttctcataatttgatggataataaaagaaccaccacgcattgccgattgtggtgattctagtcgatttttaaattggtttttaccagcttggtaattaataccaagcgggcttgtcaccatcagtattaggtttgttaacacctaaagacgtgcgaatgttacttgtgggatcttgggttaatttaacgacgagtgccgcaatgctcttacgagaaacttcagttcccttaaacggatcgtgtcgctgggttatttcgtagtcgatttcgtccttattagtcaaccacgcggggcgaatgattgtgtagtcgagatcggaattttctaggacttcagccgcggcgtagtagcgcgtcaggtaactacccaacgttgcgttgttccattgaccgaacttgccgggaacttcgtcatagatccctaaagttgcgaagatccaaatgagccgtttgaggccgctggtatgcatggcttttaacacggtttcagcctgctgcttgatgttttgaccagccaaattagcataaacgacatcttgtcccgtcatcgcctgggttaatttggcttcatcagtcgtatcaccatcgataatcgtcacccggtcagattgttggtctgcgacccggctactattacgtaagtaaagtgtcaaattatcagttgtgttggctaaaaattgctgttcggctaaacgagcaatttggcccgcagcccctaagatcaatacatttgtcatataatcccctcctgaacatcttaactgtaaacttaattattacagaattcaagtaagcagtttcaaaaagttaagcaaatttgtgccactttttgaatttagacttataatgaacatgtagcgaagttgtacttcgctgtccaagataaaagaggcgataatcatggcacaaaagcttagcaaggaacaaaaaaaaggctatgattcaaaaagccgaagaagaacgtgcaaagcatccaaagaagaagagtggcgtttccggtttcgaaacgatcgatgaagatgctaaaaagttatctaataactaataattagcgtgattcttcagttagggcgagacattggtcgcgcccttttatttatgcctttaggcccggttgagtgcgctaaagcgtgcgaaacaaaaaaccacccgctttgcgggcggatggcaaaatggttaaactcaaacgcccccatcagatttagaatgtaggtgtcagagccaaacattcaaaatcgaaaggggacgtcagaaatggcgaataaactaaacagccttgcacataccaagtggctgtgtaagtaccatatcgtattcactccaaagtataggagaaaaataatttataatcaatatcgacgtgacttgcaagatgatattcgcttgctatgccagtataaaggcgtaaagatattggaaggacatatgatgcccagaccacgtccacttgttggtaagcatcccacccaaattaagtgttgccagttttatgggttatttaaaaggtaaatcggccttgatgatgttcgaccagcatgcgaatttgaagtataaatttgggaaccgacacttttggtcagtcggctattacgttagcacggttgggcttaatgaagccaccatcaggaaatatattcgtgatcaagaaaaacatgatcaagcgcaggatcggttgagtgtccgggaatatgaagacccttttaagggtcaaggcaagtaataacaacaccgcttaaagcggtcgcaaaagtgacaagagcagtttggctttgatacacaaaagccagcgccttgagacgctggctagtacatagggcttatagccctggagcaaactacccgttttacgggtagttatgattttgtccaaaatgagtgcacgggatcgcctggtgatgattgactggttcgagcaaaattgcagttggcactggggagactgatggtcggttgttagcaatgctatgacagccatccatttgaatagctgtcacatcagtcttgcagtataatagcggtaattaatgatgggggtgacgcaaatggatcaatttacagcgtttatggcgcagcttgataagacgttggcacaagagcaattatcgtctactgatctggtgtacgtgccagtaacctttagcttccataatcagcgcttacaggttgccattaatatgctccaaacttcatttaatcagggtaataatgtatttggggtgcctgatattctggatcgaatcagaatgttggtcggtttggaattagctgatcgcccgcagtctcgctggcctacgaagatgacgacccagcaactaacaatcacgccacataaaatggtcagggtgatcccagttgatatgcgggcatatcaagtggagtgatttagcactctgatacggagagtgctaaatcgttgcaatcttgatgaaagtgcttattattaatgatgtaaacaaattgaaagggtgatttcataatggctaacgatatgatgaattggcacaatgatttatttgatcggttgaatgactggactaagatggacgatttggttaatggattcggtcggacattcttaaatgctggtagtcatgggtcggtcctaaagactgatattaaagaaaatgacgatcagtacacgatgaaagtcgatgttcctggaatcgataaacagaatattgccttgaagtatcgggatggcacattatcgattgctgtaaaacgcgatagtattagtgatgaaagcgataaagatggtaatattatcgcgagtgaacgtcaaactggtcgctttggccggcaatattctttacccgacgttgatgttgacaagatcgaagcacgatatgaaaatggtgtgttgcagttaactttgccaaagaaggcagctgcggatacccatcatattgaaattcagtaatggtttatatgacggacttgccgcgattggtggcggggcgtctttttattgtatttatagcggatgaaacggttacaaaaatttgtaaatttttgatgaaatctggagtcagatactcacatctttgctggatttctggtacaatttaatcctatcgatatatcaattgaactgaatattgataatgatgggatatgtttgttgtcggatttgtaagaaagtaggaatgcgtgatgacggaaggttttagaccgagtcaccctaagattgagattgacgatgaccctggaatacgggctcaaatcgaagctttgactggtgaactctcacaacaacaattggctaaatgggcgttaattatcgccaagaaagccttgcagtatgttgataaccaacagaaatatgatcgacaattgcgactcgcaattgatgctaatgaattgtggcaagttaatcttgttagtggctaccaggtacggcgggcactgacaagattgactaagttaagtgcaaagcgacgacgagttccattggcgcggcggcactggactgcgttcgctgggccgtagcttccgcagatgcggatgaaaatgcgctgcgggcctcggaccaagcaattaaattggttaatttaacgcaaccaaatgacatggttgcggtcactgccgagcgtcagtggcagtacgatcagttagctggattagcagctaacattcagcgaggggttacgccgtatgctataatcttcacagagattaaattaggtggggatattttatggcaacggtacatgcagaagcaaaggcggagttgttacgtcagtatcaagaaattgtaacgaagtatttaacgaatatttcggaaacagtggacgtgaaggcgcattttgaattaaaaaacgaaccaggatttaattattttgtggattatttgtttttagccaatgtttgttaccaagcgagtctggatattttgaataatgaagatcaaaaatatccagatattaataagcgggctagcagcggtcatcttaaaataccccgagtatttgacattggccgttttcaatgccgatttccaggatgaaagtgtgacggatcactacgaaaaacactcgtagatttggctaacactttggattaatttgtaaataaggtggtcacgaacttcggatagacgaagcctcgtggccttttttggagggttagtaatgattgaatgggatgcggcaacaattaaagattttcagacgacgctattagattggtttgatcacgaaggccgcgatttaccatggcgacatgaccatgagccttaccacgtctgggtctctgaaattatgttacagcagacgcaggttcaaactgtgattccttattatcagcgctttatggcactttttccaacggtagcggacctagctgccgcacctgagtcacagttgttaaaggcgtgggagggcctgggttattattcacgtgtccgcaatatgcaacggtgtgccaaacaattgttaaaccgattacgatggacagtggcctcaaactgccgctgagctgacggagttgattgggattggcccgtacactgcgggagcgattgccagcattgcgttcaatgaaccagttccagctgtggatggtaatgcctatcgcgtctttagccggttgctcaagattgatgcggatattgcgaagccccagacccgcgctgtttttgaacgggtaatcagtcagattatttcacaagagcgacctggagattttaaccaggcgattatggacctcggttcaagctacatgacagcgcggcaaccagatacggttcattcgccggtcaaacgctttaatcaagcttatttggatggggatgagttagcctatccggtcaagacgaagaaaccgcggcccaagccggttgcttacgtggcggtattagctaagatgcaggatcagtggttgatgacgaagcgaccgagtaacgggatgttggctaatttatggacggttcctttacagattccgattgcagatttagacttagatgatgattaccaacctgaagaactagttacggcggtagaaaattattttaaacgtgaatatcagctccagctaacggcccattatctgaccgggcggcctgtgacccatacgtttacgcatcagaagtggaccgttcaaggtttgagtggtcaagttgggttaagtgacttagcctactttgctggtcagacttttacgttgattgagcggcagaaacttccaatgcctaaggttcaaaaaaatttttgcacgctattcaattgattaattcagtcaacattaaatacttttcacccttcagatgtgctatggttgtggtagaatatagcaaatcaatattgtgacggagggtcgcgcatgttaaatgtatttgatatcgttaagttaacaaagatagaccataaagaagtcgacagtaatcaagtggttgttacagatggtaacggtaagcccaatgcgattttgaccagaattattgaatgatgttgtgggaaatatgcggatctttattaacatggaagatgtttattcggtcgatgacttaatgcgcgcattggccgcccatacgccattgccacaagatgtcttagaagaatatgaaaaggtattgcgggaaccgatttataacattaattttgtgccgaaaaggggccaagttgaagttgtaatcggtgaaggctaacgtgattgtcataatcatgataagatgttagtcaactcattgtgatgaaaatcagggccattcgtgggacctgatttttttgtgctgaattgatgatagtggctgtcacgaggactgatcaatatgtggttgcgggaaagtgttggttcgatttaacgataccggcttttgcgttataatggagtcaacttatggtcatgaaatgtgataggttattgtaaatggtcatagattgtttaccgcatcgtacgataggaggagtgctcattatgcaattaaaattagaacggatttacacgaaaccagttgatacggatggttatcgggtgttggtagatcgcttgtggccccggggtatttcgaaggttaacgctcagttggacaattgggtaaaggaaattggcccgtcgaccacgttacgtaagtggttcaatcatgaaccggcgaaatatcccgaatttgtcgatcgttaccgggctgaattggatgagaatcccctgacggccagctttattagtcaagttgctgaacaactgacgaagacgaatgtgatcttattgttcggtgccaaggacgaacaacataatcaggcagtggtactgcgtgattacctgaaggatagtggtcaattaccaaccgcttaatataaattgcgtaatattggtatagatgaaattgggattaggcccgcaataaactgcgcccatcaaattattttaattattttttgaaaacgctagcaattagctgcgaattttgctatgattatgttgttaattaatgatgacgtcaactattacagtgcacaataatgggggctgcattgttaggcaagcaagattggggataattttatgataaacttatgtgtgttaccaagtaccgcaagttgtcgcaaggcccaccggtggttactcgaacaccggatcccgtttcatgaacgtaatatgaatgcacagccgttaacggagactgaaatcaagcactgctacagtacacgtacaatggcattgatgatttgatcagtactaagtccaatgcttatcaccaactgagtaagacgacaccgattgaagatatgccattaagcgaagctgttcgggtattaagccaaacaccgcaattattgcggcggccaattatttttgacgatcaccgacttctgtgcggctttaaccaagatgagattcggatgtttattccacgtgaacagcgcgtactcaagatgcaagcaatgtcagaacatcagatggcttaaaatgatcggcttatgagttgatgccgtgtgtttttgggggggcgaaacattataaaacagtactacttacttgccagtataaactgattgtcacagttaagcggtgctgttttgtgtgtaaattgacaaattacagccatttagttagtatactaactaaatggtggagggtaaaatggataatattggttatttactaatgcagttttccaaacagttacgttatcagctaaatcaacggctaattgctaacggattgacgattcaacaatgggctgtgatgcaacaaatcagtctttgggtcgaaagaacggcgcaacagccgactgccaaccagctgtgccacgttctcgatatggaccggccgacgatgtcaggaattcttcgacgcttagctgccaagcaattggttgaacaggaagttaatccagcggaccagcgagcaaagctactacgcttgacccaagttggcatacaagaattgcaggccggccagcatattagtgatcaggtcgttgcgacggggcttcagagaattgacggctgctgaaaaacagtctttaagacaactgttaaaaaaactagggagcgattaataaaatgaaaatactggtgattggtgggacgggaaatattggcttaccgttaattcaatatctagatcaacaggtgggagtgcaagtcgttgctggtgcccacaacttacataaagacgagcaactattggctacgtatccggatgttgaaattcgacgttttgatttttagacgagacgacctttgatgcggcgttgcggggaatccaaaaggtctttttcgtgcgaccaccacaacttgctaaacccaagcaagatatgtggccctttctcaaatgcttacaagcacaccacattgaacaggtcgtatttgtttcgttgatgggtgttgagcataatccaatgacgccacatcatcaaattgagcagatgattgaacagttacagttaccgtacacattcattcgaccgagcttctttatgcaaaatttgaataccaacgcatcgcgtcgacattcagcaaaatcacgatttgtttatcccagccgggcggtcgaggacgagttttattgatacacgtgatattggtgagattgcgggcgtggcgttactagatacacaatatttacaacagaaattgactgtgactggtccagaagcgttgacttatcagcaaattgcggtgctaatgactgaatcctttggtcacccggtaacgtatcatcgaccgagcttatggcggtttcgccgcgtgatgttgaagcggggaatcaagaaggactatgttaatgttatggtaatgctgtatttgattacccagttgggcaacgctaaacgcgtgaccgatacggctgaaaaagtgctgggtcacgctccgcatacgatgacaacttacttacgagattatgcggatcagttacagtagttaggtcgaggagtagacatgtcatttggcagttgtgggttaattcagtggtgagcatggtcaacaaaaaaacagttacctcattttgaggtaactgttttttagcggacatatccagtacagactagctaattcaagcaaacaggcattgaagtaggatgcccgctgatttttataggcgataacgactagcaaatacaatgcttaggcatacttatgtgcaattttagccgcaacggccgccgcgatcgcaccaactaggtcatcaataaacgtgttaacaacgcctgacttatcagtatctaacttcttaatgacgccttctttaactttatccacgtaaccataattagtgacgccgatggtgccgtaaatattcgccatattaagtgctaagccttcatcaacaccgaagacgccggcgtcactggcaatgatagattggagcggctcgtttagctggccttctgtggcaaggcggtcgagttctaacgcaaccatcgcattgttcaatagttcgcgcttatgcagtacttcttgcgtctccatttcgcactcttcgattgttaagttcaagggacgtattttgtttgtaagttataagtgatatgcgcaatttcatgataagtaatcccttttgcggctaaggcttgaatgacgaactcatacgcagccttatcaggatatttaaacgttggtttttccatagttaccctccagaaataaacaatttgagtaggttagttatttaacctagtaagtccattataacgagatgggggctaaagaatatgatttgggttcaatattcgttggtgcgggttaaaaaggcgattgttgaaaacgatgactggttattttaattgaaacgcgtaaaataagactgttaaacataatgaagggtaagataattttgatgaaacgttggcgaacggtgattcaattgttattgattgtttttgttgtcggtgcggctgtgattttagttggggcccggaatcatgataccaagattacgaaaataacgagtcaattgacaccgcgttctgcacgaatattaaagaatcaatatgattcccagtcaaagacagcgacggtctttttacatggctacaatggtggggcgtattcgacgaactatctgatccgtaaagccgaaaaagcgggggctgcccaaaaagcgttagtggtgcacgtgtacaagaatggtgtgatggcctttaagggttattggcaaaagtcaatcaagaatccgatggttcaagttgtttttcaagataatcacgcctcacaaaaagcccagatttattggttacaccaagtcttagtccaactaaaagcgaagtatggcgtcaaagcttataatgcggttggtcattccctcggggccaatgatattgtcaatcaggcattgaagtatgggcatgacaaacgcttaccaacgttgaataaaatcgtgacgattggcggaccgttcgatggcctgaccgggtttctgagcacgcagacggaagcaacggtccggcgcttggatgttaaaccaagtcgtttcacgaagcatttttcagaaatagctcaagtatcgccacaattttccagacaacgtgaaactactcaatgtctatggagatacaaacacggggtataacaatgatggttttgtgggtgtcgcttcagcgcgctcaattcggtacttgttgcgcggaaaattagcacagtatcaagaagctttctatagtggggaacaggcggcgcattgcgcgttgaatcagaatccaagtgtcgctcacaagatgattgcctttttgtggtaagtgttattgtgtcaggatgggtgcattaaataaatgaggtcgttcgggtaaatactcgggcggctttttttcgtagcgccaaattaggcggtcaaacgcagcaactacagttttggtgacgttttcaataaggaagacagctttagaaaacaaagtattgcgacctattcgtcgttaaaaacaggggttaatagttaaaaatcgcaattaagtgaaagttagagcgtgctataatgacacaacattaagattttacaactgcaaaagtcattaaaatttgtggagggatcttatgaaaataactaatgctgatggcacaatccgggcgcttagtaaccggcatgtccaaatgattgcaattggtggcacgattgggacaggattatttcttggttcagggagtacgatttcaaagacgggaccgtcagtcatgtgggtgtacttggtgttgggcttcttcttctttttaatgatgcgggcaattggtgagatgttctattctgatcctacccaacacacattcgtggcgtttatttcccgctatttgggaccgagtgttggtcattttacagggtggacctattggatcggtttgatttttgtctgtatggctgagctgacggctacggcaacgtatgtcaaattttggttaccaaatgtccccgcctggctaattgagattagcttcctgttaattttggcgggcgttaatttaacggctgcacggttatttggcgaagcagagttctggtttgcgatgattcaaagatcgtcgcaatcgttgcactgattatcactggtattttcatgatggtgggacatcacccaaccccattaggccaggcttcaatcggcaatttgttccataattatcaggtctttcccaatgggatagctaattttatctcggcatttccaatggtcttctttgcttttcagggcattgaatttgtcagtataacgattggtgaggccaagaaccctcaccgcgttatcaaaaaggcggtcaatgaaactttgttgcggattttgttgttttatattggtgcgttaattgtcattatgggcattattccgtggacgtcactgtcacccgatagcagtccgtttgtgcaagtcttcaagttggcggggtacccagcagcggccgccatcattaactttgtcgtcttaacgtcggcagcctcatcgctaaatagttgtttgttctcagctggacgtcacttctatcagctagccactgaaatgccagttacgagtcgcatgcaccaaatctttggtcagatttcgaaaagtggtgtgccggcagcagcaatcgtgttgtccgcggtactagtgctagtgacccccatcatgagtttaagtgctgcaacgacggcagtttttaccgtcgtgaccgggatctctagtgatatgtacctgattgtttacacgctggcgatgctggcccaccggaagtaccggctatctaatgactatctggcggatgggtttaagatgccggcgtaccgaatcacgagcccactgacgattgccttttttgttctcatttttgccagtctattcttcattcaagctgatattgtcggtgcaatcggtgcgattatttggacgttactatttggtggcatcacttttgcccaccaagcgcgcttgcgagctgtaacacggtcgtaatcttaaaatgagaattatattataaaatggcttgacgatgataaaagatggtggtattgttaatcacaagttaataactgtacgataacgttgttacatcaagtagacatagtggtaggtgtcaggaagccggtggttgctgcgaactggtcagctactatgattgaaatacggtaaccgagtttcgactgaacggataataactagaaccgttatcttctagtgagtggtggattaagtgtcaataatccgcaacctgggtggtaccgcgactagtctaatcgtccctgttgttcatatgaacaatggggacgatttttttgatgaagaggatgagaataatgacaaatcaacgctgtggtgggattgcacgatattaaaattttgatgatgaatatgcgtcactggaattttatcaatcgaaggggtaataaattatgaacaaaacaaaagcaccacaaattagtaccttagaagcagtcattgtcttactggtcgtcctcggaattatgagtgcgggtgtgattggttggggattatcgccccaagttcccgtattactcgcaatgggcgttgtcactgcttgggcgatgttgcgcggttttccatggtcagcagttaatgccgggattaaagagggcattgataaaggaatcgtgccaatcttcatctttattctcattggtgcgatgatttcaacttggattgcggcgggaacgattcccacactcatggtgattggattcaaaatcattaatattcagtggtttttgccatcagtctttattgtttgtaccctagtcggtgcggcggtcggcagtgcctttacggtaacatcgacggtcggaattgcctttttcggcatgggcgtgaccatgaatctgaatccagccttagttgccggtgcaattatcagtggtggaatcttcggcgataaattatcaccattatcagaaaccaataatttagcttcagccgtagtggatactgatctttttacgcacattaagcatatcttatggagcacgctaccggccgggctcatttcattaggcttgtttgctatgctggggcacagtaatacggagacaaagcttagccaagatcaatcaaacagttgcggttttaaatggtcatttcagtatctcagccttggcattgttaccaatcgtcttagtcttcatttgtgccgggtttaaaatgccagccattccaacgatgcttttaaatatttttatttcggcgggcttgattctatttgaacagcctgagttatcactggcgaagttaaccgccattattaacacgggatttgtttcgaagacggggaatacgagtgttgatacgttgctttcacggggcggaatcgtcagcatgatgagtatggtcgcgttaattgtggttacgctatccttaggaggattgttggtcaagtttggactgatcaatcaaattatgaccccggttgctaagcacttgaatagcgatggcaagttagtattggcgggtgtattaacttgtattggtgtcaacgtgtttgttggtgaacaatttctttcgattatcttaccagggcgcgcttttcgccagggcattcaatgatggtggcttatccggaaatgcactggggcgggtccttgaagatggcggtacggtgatcaattacctagtcccgtggggcgttggcggcgtcttcctgacgacgacgctgggagtaccaaccgtccaatacttaccgtttgttttcttcagtttactttgtccagttatctcggtaatcatcggtttcactggtgttggtatggcgcacttgaatcagcgaactgcagtgaaaactaagcatgtgactgcgacggaagtttaatcgttggtcgatcagttcactttagggaaggttgacgaatggctgttaaaatagttactttatgtgggtctagaaaatatgcggcagtatttgaaacggttgagctggctctgagtaaacaaggtgttattgttttaaagccagctttcagtgatgaagtattaacaccaattgaacttcagaatttacgccagacacatttgaaaaaaatcgacttggcagatgaatgtagtggtcattaatgttgctggctacattggtgagcggactaggcaagaaattggctatgcacagcgtcaacataagagaattcggtattacgcagttacggaaaacgagcattaattaaaatgaccagtatcgaagaatatcgatactggtcattttgcgttgatttagtaatctttacttgagtttagtagccgcttgaaaatctgcgtacatgggatggttcaaattgatcccgcgcgatttggcaatgaaccaagctaagacttggaaagggataatcgcaagtagtggggctttatacggatcagcaacggcttcgagctggagggtttgatcatcattgacggtcggttggtcaccagtgagactgatggtataaatgtggggcgttaatcgcgattcgtacgtcttgacggcctgtaattgggtcatgacagccgggtctgtattgatttcaagatagaactgacagtgatcttcatgcgtccccataaagcccaccgtgggtaaatgaggctaatgagtaaccatgcgttggtacccggaggatttcggtgaatttggcttgcatttcagttagtgttccagctaggacgttagcaccgatagctgtaaattgaggggcgttagtgaaatcaatagtgaacttacgatagaagttgttcgcccgttgaacagttggattcatgctttcaatcagaaaactgaactcgtctaattcttgattgactgctaattcggttaaccgtgcttgaagggcagcactgcggacggcaagcaacattaaagtgagcacgatggcttgaaagcttagtgtaatatagggcactgattctttgccagttagtaagtcacaagttgcatcggccattgcggtcagagcagtcgatttttgattagtcacgataatgacatgagcttgactggccgtgtgggctttttcgattgccgcttgcatggttggatcatcatcttttagagaaatcccgataacaacatcgacactgggatcagcttcctcataagtgacgtagaggtcggccgcagcaatggtcacttggagggcggccgtcttttgcatgtataagcgggcggtgttggcggcgttgagtcttgaaccagttgcgaggatcaaccagtgttgtggatgatcaggggtggcagtcaaggccgccgtaatctgtttgggataattggttaacaaccgctctagtactggctgttcccgacgaatgtatgagagcatggtcggattattcatcatcatcaaaatcatcagctcctaaaaatagttatgtatattaatattaatttagctttattgtaaacgtaaatgaacttatagtcagcaaaagaatgtttaaaaatatgactgttgattaatcgtagcgggtccgctttaaatcaaaggcgactgctcgcaaatcatcataaaagacgacttaacggccaacagttttattcacgggcttgccattatcggaacatgttgcgttctcaatgtacgcagaacaacatcctaatcagcattctggttagatggcgtcaccagtaagggaccttgtcgcaaatcgtatgccgttcatttaaaatgccagcgctgtttgtggcagacccgacattgatttaggtgaatattcatgtctagttctaagttcattgtaccaatcatttatgataattagggcttgcatgtaactgaaaaggctggtaaagtaaggaacaatttatcaatacaactaattgcctatataatgccatgatatggatggcgagtttctacccagtgccgtaaacactggactataagcgaattgagtcgacgggtctacactgcttaatttgccgtgtggacccgtttgctttctccgtaggcagactgactagtgaggagaaaataacgatgacgaagacagttgaaatggtgattactggtgcacaagtgttaaacgtttatacccgtgaatttgaagccaccagtttgtggatcgatcacgggccggattattagtaacttgcgtgacgagccgtacatagcggcccagcatgtcgatgcgaccggtcagtggatcgttcccggcatgatcgatgcacatgtgcatatggagagttcgatggtggcacctagcgagttgggaaaagtcttactacagcacggcgtcacgacaattgcgactgatccacatgaacttgccaatgttgcgggtattgctggcattcagtacctaattgatgatgcgcgccaaacaccactagatgtctgttttatgctaccgtcatcggtaccgtgtgttccctttgatgataacggggcaacgctacatgctgctgacttgcgcccactttaccaacagtcggaggttcggggactggcggaagtaatggactatggggccgttgcgcgtggtgatactgacaccctggctaaaattagtgatgcctatgcgtatggctatcatgcggatggtcacgctgccggtttgaatgcgcaccagctcaatgtgatgcgcaatgtgggactggatactgatcatgaatgtatgacagtggcggaagcacaggatcgtgtgcgggctggtatggctgttttcttgcgtgaagggacggttgaacgcgatgttttgccgacgattggtgcagtgaccgaagctaatgctagccggtttgctttttgtacggatgataagacgattagtgacttgctcacagaagggtcgattgattataacgtgcgcctagcgatgcagagcgggatgcgtcctgaacttgcctacacattggctagtctcaacggcgcgatggcgcatcgtttaagtgatcgaggcagtctgtcagccgggcagttggcagatttagtggtcttagatgatctcgaacacgttaggattgcgcggacgatgaagcggggacagtggatattaccaagcacgacaaaaccattgccgtttactgcaacgcgtgttcagcaccatgcacaactagccgacttccaatttaccactagcgaccgggttggcaaatgtaattggtgtgcagccgaaccatatcgagacggatcacttaacactcccgattgatgcaacgcagaattttgaagcggattgccaacgtgatattctcaaaatggttgtcatcgagcgccatcataacacgggcaaggtgggcgtcggcttagttcatggcttcgcacttaaacagggagctatcgctggtacggtggcgcatgatgctcataatattgttgcggtcggaacgtcggatgctgcaattttacgggcggtagcccagattacccaagataacggggaattgcggtcgttgacgatgaacaagtgctagcgaccatgccgcttgccattgggggcttgctgtctgcagcgagctatcaaaaagttgctgaacagttggccgaacttaaacgagcgtatgaggtcattagcgagcggccacttagctttgatccgttcattacgctatcgtttttgacattacccgtggattccaacgttgaagttaacggcacgggggttattcgattacgcgacctttgactttattccagttgcgattcaggataaccagcgccaaacagtttaagtacaatcgttcggtgactgaaattaggctatgatgtgtctgctactgaacaacgatgtagtttaaggcttgtgccgaaatatgtttaaagccccgcaatagctaaacgttttagttagctgctgcggggcttttactgtggttttaatgggctaaatggctgctactgtgaagcgtcattaatgcgggggtagctaatgggattgccactctcataagcgggaagatcagcgattccgcggtaaacggctcgttcaatctgctgcagcccgccgccatcagcaatcgtcattttaataccgtaatgcttgacagctttattcagtgttttggaagtggcgtgtttattctgattctgaatcatgaccacgaggtctgcttgaccgatttgccggtaatagaagttggtgctattactgtgtttaaaagcatcaatcaataaggtgtgcccgttgtgctcatcaatgagttgcgtgatctgtgttcggcgcgtaccaacgtcgcccatgacgatggcaactgtttttcgtgcagatcaaagtctaaggtgcgcagcgtcactggcacggtggttgtgtggatagtagcctttttagctggtttggctgctttattcgaggtcggttgactcgagctatgatgaacgtaacgaataaccaccttctcaggccgctccttataccaagccaggtcgactaattgaccattactgatgcgctgatattgcgcttcttgactagtgaacgtaacatcgttcattgccggattgagcgacgataaggttgtgccgttataatcttgttcgatgtgataagtatcatcggtgtcttgataatgaacaacgaaaaatggtgcgacagtaatcggatccgctgtagtagcgtgactaacgattttatcaatataaggttgtcgatgttgccgtaaattttgttctaacaggacctgatcatcgtggtgaatcaccagttgtcgggccaaaatttcatcgtagtggtagcgtggtgtgacggtcggatcattggggtcgactaaatcaaaaccctttaaatcgcgctttacttgcatgattgtttgcccattggattgtgcagaagttgttttgacggatgatgatgaatcttccgcgtttgcttgcgtagcgtggccgctggtctcattgtgtgcgttactagtggctagtctagctatgcgtgtattatccgaatctacgatggtatcaggatcaagcgccaggtttaagatttcctgaatcgctttggcaccctttgcgaggccttcatcggtaggttgaatcatggtcaatgttcgggcaatggcggtacgataatcgcgatattttttcaaattaggacctccgttattatttagtaaattggtcagcgcagacatggttctgttgctgaccaaaaagatatttggtacagggtcaggtcataaccaacgatatgtatgtgttaataccacgagccaaaatgattgtgttatgctggtttaaagaaccaagtaggtcatcaattgccagtacttatcaactattgtgccatagattgtggctggacgggtataaaaaaacaataaaaacgagttagtgaagttttttcaagattagctgagctttagcgcaagtattggctgattggaacaatggtaattgttgtgaaaggtcggcttactaacacagcaatggtcaattgaattggctttacgggtgattacttataaaatgatatagcggctatcaaacgacaacgagtgcgttgacttgtttgtggattgcaatagtcgaacatcacattcaggataagtgggaatgaagttggaggcgcagcagatggcaacagttagatttgagaataaacgggtcaatatgagcaaactcagtcagtttggattttggaacccaatcagaatggtcagtatcagttccgaactttaattatgcaaggccaatttgaaatgataatcgagttgaacactgatggcagtctgaacacgatattaacggatacgacgactagtgaagtatatgttttacacctgacatcccaagtccatggtcaatttgtaggtcaagtagcgcaggcctatcaagatgttttatacaacatcgaacagcattgttacgataatgacgtcttccaatcgaccccggagcgtaagctgattgcgcaagtcaaagctgtttatggtgacaatcttgagttcttgtggcctaaattcccacaaaacgcggtttggcgacgctcagacacgcacaaatggtatggcgcattattgacggtaacttccgataaactggcgttgccgggcgcaacacatgttgtgacggtattagatttgcgagcgcgcccagaagacttatctatgctgattgatggacaacattatttaccggagctatcatatgaataagaaacattggtattcaattttgcttgatgatgtggtaccacttgccacgattatggacgacgtaaaagttagttatatgttggccaagtaggctttgaatgcgagtggtcggtctcaccctaaaccgaagcattgagcattaactaaaaaatcgttcccaagaagacatctgggaacgatttttttgattaatgattggtaaaaccatcgttagtgactattagattgaataattagcgcgaggcatggtgccgactgcggtaccaatcgaaggcgagcgttaatagcatgtaagcaaaatcaacgagaattgcttcttttagtggtacgttgagtaaaacgactgaaacgaacgttaaaacaacgacaaaagtcagtgccgattgtgcccatcgtaagagccattctggcatggttagctcacatcctttgttatgggagttgtggttgttgatgagactgatgattgtggccgatcccggtaatgcacgtagcgcccaaagaattgagaccgtatcaacaacttcttgaagcatagcgccaaagagtgccggaatgataccagtgctggcaatcaacatcaagattgtacagatagcaatcccaatccaaacggcttgtttagccacttgcatggtatctttagcaatgcgcaccgccgtgaccacgcgactgagatcgtcttttaagatgacgacgtcggccgattcactagcagcagttgagccatgggcgcccatggcaatgccgacgtcagcaacagccaaggaaggcgcgtcattaacaccatcaccaaccatgataacggggcgttcggccgctggtacagcctttaagtgggcaatcttatctgcgggtaggaggtcggcagcaacggtatcgataccgacatcggcggcaatatgatcagcaattgcctgttggtcgccagtaagcatcatgacgttttgaacgccctcagcgtggagtgctttaagcgtggcggctgcttcggggcggacattgtcaataaacgtgatgtaacccgcgtactggtcatcgatgccgacgtagatagcagtggtagcaagtggcttggcggttgtagtcggtgcgacgaatttaagtttgcccactttgacctgttgctgctcaatcgttgccgtgaccccattacccgttacttctgctaattgtgttgccgggctgaggctagtggcactcgcatacttgacgagtgagcgggccaggatatgacttgagttttgttcagcgctcgctgcgaggtgcaagatttgttcggcagtaaaaccagactgaggaacaatttggttgactgttaattgaccactggtaatggtccccgtcttatcaaacgcggcggacttagccgtagataacttctccaacatgttcccagtcttgaccacgattccgttccgactagttcggctcatccctgagacgagtgcaacgggtgcggcgagaatcagcgggcaaggggaagccactacgaggacttctgcaaatcggtggggatccccgctgaatgcccaagctactccggcaatgacgtatgctaccagggtgaatgggactgcatagcgatcggccagccgtacgaatttggctggtcgtgattcggattctttaaccaatttgactaactgttggtattgactatcaatggctaatttatcaacaaccattgtaacggcactatcgccgttgaccgcaccagacataatgtcatcgccaacgtgcttgtcgactggtttagattcacccgtcaatgaagattcatcaaagagtgccgttccttgaataaggtgaccgtctactggaactagctcaccaggtttgacgactagctgatcaccaatttggacatcttcaacggcaatatctgttaattggccggcgactgagcggtgggcaatacgtggtgaattatcgagcaaggctttcaattcggtattcgctcgtttggccgcataatctcttctaacgagtcaccccagtgagcataattagaacgacaaggctagcccaatattcgccgacagctagtgttgccacaatcgccgtaattgctaataaatcaaccccgtacttacctgaacgtaaggttttgatcatctcaactaacattgataaggccataagtgaccccattaatgtaatgatgatttgtgctgccaattggtagtgcaaaccaaactgtaaaacaaccgcaatgataccgacgctgaccgttaaaattaatttatagtagtgccgcatgcagttcccctccttttagatgataacgttttttaacttgttacaagaataacatgaaatcggtttaattgaaacagataagaatgattctaaactaaaaactaattattacgaaaacttttaaaaagtttcagaaaaaatatgggtgtaaaactcgtctaatccttgacgggttaggcctcgacggctcaaaatggttgattttacttctgatttaatactagtatacttataaacgaacatcagatatcagaaaatactgaaatcagcatttgtataagccaacgtgcgctgtgcggtggtaacttgttacccggtactaagcgctttttggtgcaccaagcaattaatctaacagttgtgcggtgggcttatctggtgattcaagggggttatctattagcaagagcagtgtaaccattaatcgttacgtggtgtgacgacggtcgtgtgctaaaggcacgatggtaatagaaacactagctaaacaagatgaacaccaacgtcgattaagcaattaaaaatcatttgtcagtatggcgttgtccggattcaaccaacggaaagaaggaaattctgctactgattttgagttagcacaaacagaatgcggatgacaatgccggtcaaacctgatacagtcagggtgctgagtgctccgaggattaactcggaggggtgtaccgattgctagtcggaaatttacgcgtggggggactaccattgctggtaggaagaaccacgaatttgatctaaatatagagagtatatgctcagtagcgggtttattattttaaaaagtaagaatattgattggtgggtctatttaccaacaattgggctctttgcggcggcttccgttgttttattaatgggggccattcgctggagacgagtttaagtggcatcttgaactggctcacaaataacatgagctggctttatatgtcggtatatgtgatcacttttatctttttcatttacttagggtttagtaagttaggaaaaccaaacttggtgatcctgatgacaaaccagaattttcaacgtatcactggggcagtatggtttacgcgaccgggatcgatgccagcattttaatgttgagcatggttgacccgttacggtacctccaaagcccttcattcggcgtcaagccgttttcaacttctgcatataattatgcgcacatgctgggacaatttaattggggaccaatggcgtggatgatgtttgcgccagccacgattgcaattgcctatgcaatgtatgttaaacacatcaaggttcagcggctcagtgccgcaatttcagtactacaaggtcctggtaagggtaagcaaattgcccggaacacgattgattttctcgttattattgggattatgggtggtgttggtacttcagtcgggatggaaatccccgtcatttcaaaagttttgagtgccgttaccgggattgccgatacgatgactttaaagttagggttatttgccttattattcgtaattttcgccatggctgtttttaatggcttgaagaagggaatcggtcggctaagtgctgcccatgtttggttagcgattggcttcctaatcgttgttttaattgttggcccaactttgtatattttaaactcagaaactaatagtattggcttgtttgtcaataagtttattacgttgagcacgaatactgcaccaaatggtcacgcaacggccatgcaacggcagacgatcttctactggggctggtggttatcctttatgccagtcatgggcttattcattgcccggatttctcggggccggacgattcgtcaggtgctcggtggtatgttgctatggggctcattaggttgtgtcagtttctacgccatcttgggtggttatgccttatacttgcaacggatgggcatcgttaacttagttcatatcttaaatacgcaaggacaagccgctgtgattgcagcagtattgtcgaccttaccattgaagatgattatgctggctttgtactgcctatcttgctttattttcttagcaacgacggtatcttcatttgccttcattacctcgtcatttactagtaaaaagttggccgcgggggaacaaccaagtcgtttcaatcggatgagctgggtcgttatcttcctagtcttctcattggggcttgtcacggtcggtggctttgaatcgattcagtccatctgtgcgatgtctggcttcccattaacgattgtcgcgctcgtcttactgtactcgatccatcacgacttaacgactgatccagtcaaggaagctgcgaaagccaatgccaaagcagctgaattagcacgccggaaacggctagcacgtgacgttgaaatcacaactaaaactgactacgcacgcgaacggcgtactgcacggaaacgtgagacggaagccgattagcgctactcagttgaactaaatatatcaattaaactaggctcgtattatggatttccataatacgagccttttaagattggcccacctgtttgaaataatggtagaaagatgcctttatttaaagtcaacagccaccagcttaggcccgctggaaacagttccggttagcgtaaacccgcttagttcgttcgtcctacgccgctctccaggcatttctgccaattgctggaacgcggtggacacagatttaagccgaagaccacgtcttaaatactgggtcttctactaaccaagccaaggacgcttgctaagtggaatttcaccgctgagcattggccgaaacgccttccattcgggacagtattcgaatggtggacgaagatatacccaacttttgatgaatttgtcattgttctccataaacagtaattttattaatcaactgttaggtcgaaaagatattgggatagctcgctatttcggaattactatagtaataatagaacacctcaacaaagtggttagggtaaccctaacgtctcgtttaaagttccggtatcaaaatagccaacgaccaattgcaccaagttaagtggccgttcatcagccattcgagcggcttaccgaaacgtgttcggtgccactaaagtctgtgcttgctatgccaacggacaaatgcccaaaccgcattaatccgttggctagacaatgctcggcttcaacccgtggcttgagactggaggggctgggtgacaatgctcagtagccaaattattctctttagtcggaagtgatttccttccggcttagaataagactcgtatttgagatgacgcgggttatgcgttagctcaaatcgatgtcggctgcgttccagcaattgtcacccagccccggaggtcggaataggacgctcaccggctgacgaacagaaaaccaaccctaaaaggcatctttctaccataattcaggtgggatggattagaatgatagcgatgatagtaaagggaggattggctatggcgattagtaatgggcatgttagttttaagcggccggcgtggttgggagattcgattacggcgaataatgggttggcgacggtgcattatcatgatattttggcggctgattgggatgtcgagcggagcgataatttgggaatctctggttcaacgattgggagtcgctacgatgcgatggcggcgcgctatcaagctattcctgaagatgctgattttattgctgtctttgggggcgtcaatgactatggtcggaaattcagccgttagggcaatacggtgattgcgatatgacgacattttatggcgcgttaatggtgttactgacgggattacagacgaattggctgaccgtgccgaagttatttatttcagcaattcatattggttctgattttggcggcagttttagtgcggtgactaatggtctcgggtatcgtcagtcagattatgaagcagcgattgcccagatgactgcggactatggcgtcccacatttgagcttgtaccgtgatgcgggaatgacgtttgcgattcccgctcaagcggccatttattcggtggatactttgcatccgaacaatgccggtcatcgcgtgattgcacgcaagctgcagtcgtttttggatagccacttttaggttggcctagtcagtaatgaatggcacagttgatcgtaaataaaagcagcagcacgctaatgggcgtactgctgcttatctgaatctaggtgccaaaacgggctacttggctttttctttagtcttgggcccttgtttatgcttctgctcgcgcagcaagtctttgaaggtttcgatttccgtagtgtgcttagccatccattccttgtagttagaatgggagtcggtatcgctgattttaaggccggtttctaaccagaataaagcttcggttagggaaccgaaattatgaaaccagagtgtgtggccgttgtcagagtccatggcaacgtaagacttgtagtggggcgttaaaaaggtatgtttaacaattttgaatgcggcccggcgacgagttaatttgtaatccggcaagatatagcggccaggatgggccagatgtgggacagagttcttacgttgttctttatattcagtcaacatcgctttagcgcgttcgggactgatgagggtgatatcaaattttggcatagcggggctccccttggtgaatagcagtatggttaattatagtagtcaaataataatacttatactataatgatagcgcaattttatgagaaaattcgaaatataaaaacctgaaaattagggattttccctttcttacagtaaatttaagtaaaactaatcggaggtttgattatgagtacagcacccctcagttcatttgaaaaaaatattccggcggtaaccgaattgttagcggttgatgctgaattgcaaacgttctttgtggctttgacacctggttatcagcgcgaatgggcccgctttatttttggaactaaggcacaagcaactaaggaacggcacattgaagttatgaagacggtttttcgagctggctataaatctaagcgagtgtatgatagtcggtcggataaataggtggattttggcaatttgaaatacggtgacggattgcgattaagaattggggtgtagccaccaagatctaagcgggtctgggtcctgatttggtctaattgctgtcaattctgtggctagcgggccttgtgagtgcctctaaagcccgcaattctgcttcccgagcattaagcgtggcctcaattgctacgctgagcgtgcgctttaaccggcttaaacggggaatgtctagactgacatcatcaccataaattgtttccagcggtgtccaccagacgggaccggggttgggcgtatcaccgttatggcgaggaaataagtgccaatgaacatgcgcgtcaccattcccgagtagttcaatgttcattttgtctgcatgaaaggcacgcgcacaagcttcctggacgatactcatctcctcaaggtatcgtaacttctcgtgtgccggtaaatgatgtaattcggtaacgtgatgtttggctaaaaagagcgtgtagccttcaaagtactggctatcagcaaggaccacgtagcccgttgtgagttcgtaaacgaaataaggattctgatgtgcctgaattagtttgattcgttcacagatcgtgcaagtggatgtcattcgctcgcctcctgagtcttgataagattaagtatacgcgtagatcgtggtgagtacatcaaaaatgttagtgaaacgtctaaaaaacgacgacctgaaaatcaatcctgatttggggtcgtcgttttgattgtaaaaactaatcgtcaattctgttaggtcgatcgtgattaaggtaaatcgttgccagctgcaaagtaaatgtcgtaccattcttgccgagaaagcgtaacgtctgctccagcagcattttgagctagatgttccggattcatcgtaccaaggatgacttggaagtgggctgggtgccggagaatccatgcggtcgcaatagctgatttagtgacctgtttctcatcggcgagtgcttgcatggcattattaagttctggaaacttcggattgtctaagaagatacccgcgaagttaccgtattgataaggcgaccaagcttgaatcgtcatcttatggagccgtgagtattcgatcatctcgccgtcgtggttaagactacgttcgtcctgcatgttcgtgtgcaagccaaagtccgatcgcaccggtatgcatgataccaaattggagttggttgatgatgagccgttggtttagtgccgcttgaagcatgtcaacttgcatgggattgaagttagagacgccaaagtggcgcaccttgccgctagtttgcaacttgtcaaaagcggcagcaacttcttcgggttccatcagggcgtccggtcgatggaggaggaaggtgtcgagataatcaacacctaagcgttgaagctcgccatccacggctgccagtatgtgctgtttggaaaagtcgtaacgcttgccaggaacaatgccgccttttgactgaatatagagctgatcacgcgatacgtgagcccgcttgagtgcttgaccgaagatggtcgatgattgaccaccaccgtagatatcagctgaatcaacgtaattgatgcctaaatcagcagcggtatcgataaccttggtggcttgggcgacgtccaaagcgtccatgcgcatgatgccaagtgccacgctggaagcttgaatattgctgtgacctaaattaatcgttttcaaaactaaagtcctcctcaatgtgcaacttgatttaaattcagtatacggttttcgtaagagtatgtaaacggttacgtctggtgccgactgttggtaaatctgattttagagcaaaaaaatagaacccaaggcttctctgcttgagttctacttatgaggaataatcctgattagcaatgaaaaattgttcagtgttaatatgatacaccttcatgctattcaattttacgcgtgtccaacttctaacggactaacccgtatttattgtaactatctgctatagtcgatctaaagtaaggttgttacttgattgcgactcgttagacgggttttaacgaaagttaaactcgcgtttaaaacttgggaatgtcttcgtaacagacatgcacctccgtttaaactttgtaatacctgagtctacaaatggaactggtaatgtggaactaacaactggtcatcggagacacctgtttccaactaaaacttagttaaaatctgttcgtcattctaatgccaattaattctttgcggttatcgtttatctaagggtcaacgttcagtcatccaacgtaaatctcacgacactcgctagaccgataacgcttcacggcgcttaaaacggtttcgataacgacccaaactgtgatactagctgtctaacattacagcgacagccaaactcttttgagaagctttgctaatcgaggattaattcctttcctcacttagtataatagcataaaccgcaaacgcttacaacaaaaacaaccgcgaattcgcaataaaaatcaatagtgactcaaaacgctgctatatcggggattatagtaaattttttcgagaaatagtcgcataatttgctgattgaccgattgtttgaaaagtcggctaattagcgctaataattgattgaatatgggctgacatacggtacaatagaagtggacaagaaaagcgctttatataacgatgacgtgtatcaagtgtggtggcacttataccgcgaaacgttggcgtgattaatcagtgaattcaagctggtatggaaggacgagatacgatgacaacaacgtttaaagaccgggccttcgaggcgctaggacatgtcattgaccctgaattaggaattgatctagttaacttagggttgatctatgatgcacaattgacggcggaaggaaccgctgaaattaccatgacgttgaccattgcgggctgtcctttgaccgaatggttggctaaggacattcacgatgaactgatcaaattaccagaagttaacaatatcgagattgagattgtgtgggaacccgcttggaacgaaagtatgatgtcccgcgaagctcgaatggaactaggcattcatagttagtggccggcctgttcgcagccagtccaagggctgacggtcattggatagggcatgattaaggaaagacgttgctggtttgtctctcgcggcgcctttttgcgtgccactgtactaattccggccagcaatacgtgcatgcgtcgagccagcaaaaaaacaccagtgacacaaccatccgtagacgattgtatcgctggtgttttagtcatgctagaaatgccgatttaaagttttggcaatggcatccatgtcttgtacccgttgtaatcagcagtgtgcagtagcttttcggcatttgccacccgatcttgggttggagactcgattccttcaagccggtacttgatcttcatttcatgatatttttaacgcccaaagtatggtacggcaatacttcgacttttgaacgacgtcgtttggaattttagcaatgtaatcgccgagtttcttcaagtcttcatcgtaatcagtccgttggggaaccaggacgtgacgaatccacatatcatcgtggtgttgggccatgtactgaatcatatccaagatattttcgttcccatactgggtcaactgcttgtgttttggcagaatcgatgtgcttaatgtcgaccaacgaaatgtccgtgaccttcattagacgttcgaacttgtcaaagaaaggttgttctcgggtaaaaggctgtccagaggtatccagacaagtactgatattcatcgccttggctttttcgaataagtctaagatgaagtcgatttgtaccagtgattcaccaccactgactgtgatgccacccgtcttgccccagaaagcccggtatttagccgcgtcttcgagaatctcgtcggccgtcatttgatcgccaacgttgagtttccaagtatcagggttgtgacagtattggcaacgcatgtggcatccttgaaggaatgccacgtaacggatacctggtccgtcaacggagccaaacgtttcgatggagtgaacgtagcctatcaaaggctcctttgccgccgcttgcgttgttgaaacttgtttgttttccatgagcctttcgccttcttaactattaaagattaaatgctttacattgattcgaagaatgtccgtgaaataacgtcatcttgttgttccttggttaaatctgcgaagtagacacaatagccagaaacccgaaccgttaatgttgggtattcttcagggtgtttctgagcatcaatcaaagtgtctttattgaagacgttgatgttcaagtgcatcccatcgttcttcatgtaaccgtctaacatgtttactaacgtgtctttccgtgattcgaggtcatggcctaacgtgttaggggtaacgccgaacgtgttggaaatcccgtcagttgcgtaacggtatggtaatttggcagttgaaagaagtgaagctaatgcaccactcttttcagcaccgtatgcggggttagcacctggtgagaatggttcgcctttttgacggccatttggcgtggtaccagtgttcttaccataaacaacgttggaggtaatcgtcaaaacagaagttgaaagtttggcattccgatagaggtgatgcgtgttcatttcatcttgctgtataattctttgactaaccatttagcaatgtcatcagcgcgatcgtcattgttcccataacgtgggtagtcattgtcggctttgaagtcaacggcgataccacgttcgtcacgaattactttaacgtgaccatacttgatagctgagattgaatccgcggcatgtgataagccagaaatcccagttgcaaaggtccgatcaagatcagtattcttcaaagctaattgggcagcttcatagtagtacttatcatgcatataatgaattgcattcagtgagttaacgtaagtgtcagctaaccaatccatttgcttgtctaatttcttcatgaattcgtcgtaatcgatgtattctgaagtaattggttcgtaagcagggccaacttgatctccagcaatttcgtcgcggccaccattgatggcataaagaattgctttggctaagtttgcccgggcaccgaagtactggattccatcagcaattggttgtgcggaaacacagcaagcaatgccataataatcggtaccccattgtacccgcatcaagtcatcattttcatactgaatggttgaactgtcgattgaaacttcagttgcgtaacgtttgaagtcttctggtaagcggtctgaccataaaatcgtgatgtttggttctggtgcggcgcccatgttgtccaaagtctttaaaatccggaaagcggtcttagtcacatggtgttgaccgtcgacgcctaaaccacacattgataaggttgcccagattgggtcaccagagaagagagaattgtattcttcagtacggatgaaccgaaccatccgtagtttcatgacgaattgatcaattaattcttgagcttggctttcgtccagaacaccattgtccaagtcacgttggatgaagatgtccatcgttgtatcaatccggccaacggacattgcagcgccgttttgggtcttgatagcagctaagtaagcgaagtacatccaattgaatagcttcttgagcattagttgcgggcttgctaatatcgtagccataactggcagccatcttcttcatatctgctaaagcacggtattgatcttgaacttcttcacggaggcgaataacatcatcagtcaattcaccatcaccaatgtgggcaaagtcattagctttgtcttccattaaacgatcgatcccataaacagcgacccgtggaagatcaggaatgagacggccacgtgcgtatgcatctggtagtccggtgatgatcttgtagtgacgtgctttccgcatgtcaggagtataaacatcgaagacgccttggttatgagtcttgcgatattcagtgaaaatcttgtcgttttcttcatcaggggtataaccgtatgatttcaaagcgtcatcagccattcgaataccaccaaatggcatgaaggcccgcttcaaaggcttgtcagtctggagaccaacaatcttttcgagatctttttgaatataaccagggccgtgtgaagtaatcgttgcaacgactttagtatcagcatccaacacaccaccagcggcacgttcttgtttctttaattctaagactttgtcattcaaggtcttagtagcggctgttggtccggccaggaagctttcgtcgccattgtactgtgtgaagttattttgaataaaatcacgaatgttgatttcttcccgccagtgcccgcctttgaaacctttccaagctgctggttttgttgtcttttctgatgtaatcattttctcgcctccataatttgaatccaatcaaatgattgataaaattctatatttgaatcataacatttttgctggatttgtaaccgctttcaggtgatttatttcacgtttgggttatttttttgcaatctattattgaaaagttgactattaacgttgatataacagtacttacatagctagataggcattggtaattcacttaattatatttagaaaacggctaaaaacaaagacttgttttgatatataagtggaatattgtccataatgtaacaagtgtttaactagttaattaataaaaagtgcaacgaggtgtggagggtgttaaaagcgtttgccgttgattttatgaggaagttcgttatcataaagaagataagcagaaactagtgaatgtagtgaaaggtgggcgtaatgcggatgctcgaaaaaaattgaacaatatattgacagttgtattgaagctggcgacatttatggggcgtcgtttagcttgatcacccctaaaggtatcaatcaatactatcatggtaagcggggccgcgatgagtttgccgtgggcttagatcctgcgatgatttatgacctagcatcggtaactaaggttgtagggaccacgacgaggatttttcagttgttatcggaccacacgattcatttaacggactcggttgcccggtttttacctgggttcactcatcctgaaataacgattaaaaacttgttagcttcataatagtgggctaccggcagatattgataacctggataagatgcaacgtgaagatctgatcaaagcggtttatgatgcgccactcgtcacggcgccagggacaacgtatgtctattcagacctgggatttattttattgggatggattattcgtgcggttgacggctcattggctcgagtattcaagaccacgtttgctatccactagcgatgaccaatacgggttataacttaaatcgtccgaagattcggtttgtgccgacggagtttgatccgcggcggggtcagattcaaggacaggtgcatgattataaagcctttttgttgaatggtgagagtggtcacgcaggcttgttctcaacgctgacggatttatccgtatttattgaaatgatgttaaactttggtgaatatcaaggcaaacgggtgctggatgaaaatgtctttgactggttaggcgagtatgacgaaaatggccggacgttaggttgggcaacgacgtgcgggacgacatcaatatttccatactggttttactggcccggcagttgcttttgatttggatcgtcaaattgggctggttgtgttaacaaatcgagtttatccaactagtgacaatcaggtctggaaccaagatcgtaagcgagtattcgatctgttttttgaatcctgatgatggcagcttcattaatagttagtagttaaattaaataagcgtcgcagccacttaaggctgcgacgcttatttaattacgatttcatgacagctagaccgctgaagtgtttggcacttgtgggtgctaaacaaacgctattttgctttttgcttctatatatacgttatttttgcaaccagcgaagtccgggaacatgacgtgcaattttataaccagcggcaccgataatgacaccagcccaatttgtgatgacatcatcgatatcaacccaacgtttgaggttaaccaaccagtcaaggatgaattgtcccagctcgaagtgttagccccgtaagaaatcccaaccaaataaaacgacgccaaggcaagtcgggaaaattccatgccagtaaaccgcccaatggaacagtgaggagaacgttgagccaaaattcaatgtcaagttgttggaaaggaatcacgttcagcttaacgggcccccattgaatatattgaataacgagttgggtaccaaaattgtaactggtaggtgtgtagcaaaaagcagttaaggcccagagaaaggcaattaaactgagttgcttaaaacgctggatatttgtgcgcgctgatcgcgcacaagcgtatagtagaacaataaacattaatgaaatcaaaagaatggtagccaagctagcataatttagtcgctcctttaattaaatagtatagagaaaaaaagctggtttgactattaataaaaagaaattcagaaaaagtgttgacactttttacttcaattggtatattagtaaacgttgctgctacggcagatgcatctctcaccaccaaataattattgaaattagttgttgacaacttcttcagtaattggtaagatagtttctgttgtcgcaacggcaaccacgacaaattaatcaagttacttcttaaaaaagttattgacaagatgttgattaagatgttatgatgattaagttgtgttaagcgattgacacatggaattagatctttgaaaactgaacaaagtttcgacgaatcaaatgtgtagggtctcttgattttgaatcaagagcaaaacatttgcgaagtcaattcgctagcaaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacccgcccagaagcgggggattaacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcgaggcggtttttaagtctgatgtgaaagccttcggctcaaccgaagaagtgcatcggaaaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagagtttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacccgcggctggatcacctcctttctaaggaatattacggaaacctacacacgcgtcgaaactttgtttagttttgagagatttaactctcaaaacttgttctttgaaaactagataatatcaaatatattttttcataatgaaaccgagaacaccgcgttttttgagtttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttgatcaactgttaccactagatgaattcatagtctagttggaggtaaacgctgtgaactgaaacatctcattagcagcgggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgcctttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaaattttaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtccgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtctggtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcccgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacagacaggtccgagcggggacgaaagtcgggcttagtgatccggtggtaccgtatggaagggccatcgctcaacggataaaagctaccctggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatttggaagcggactaatactaatcggtcgaggacttaaccaagtaattggtgttccggttcatatgaagatatttgatattgtctagttttgagagcacaagtttctcaatagtgtggtgacgatggcgagaaggatacacctgttcccatgtcgaacacagaagttaagcttcttagcgccgagagtagttgggggatcgctcctcgcgagggtaggacgttgccatgcaacctaaggaatcgttaattcgattccttttttgttgccaaaaattagcctactgggcgaactaagactaaattttgaaattcaaacggcgggtcggattattaggaatcccggtactcatcagcgcatttggaattcaacccatactattaatcaccggcacgatctacttattggttgcaatcacactcattgtactgaataagtttccgttgagttgaatcgttagcgattgcgctcaatgctcatatttggggtagctggcagtgatgggggagttgtcaaaacgagagacagtagcactcggattttgagagttaggcgtaaatggcgtacgtttggttggttagaaaaatcgaatgctagttatcaatcgataaggtgattcagctcagtctaaggtactaggtattggtttacgaacttggccattactaaccgcaaatactggctgctgggcctaatgtcatttaatttggacagtatccgtcataaccatgtaaaaatcatgtaaattcgggagcaataattgttattctagcagttacgtgctatgttattatcatattttatgaagtggagtgatagttatggctcagatttctgtggggatcgggttaaatgtcaaaagaacggcaataccgattatgatttttatgctaaagttgaaaaaatttacgagaactccgccttcgtcacaattactcattatgatttgcgggatgatattaatgtggcggaacttcaatatcgggcagtgatcgccttaaagaagagatgaaactcgctaaaccgactgctggtgaagcgaagcagctacaggcagttagtgcggccatgttagctgaataaattaagaatatcgatgcaacatgtaggtaatgggttgttcaagaatttgattcttgaacaacccatttttagtttggctgtaaagcttttcggtgtgatggagtgccctggttgggactgattttatgatgattagaggccaactgacttaatgaatctgtccgttagagctttaacagattggatatttaacaatcattcacgcgggtgttgttacaagataattgtgcacgtctctttattcggtgtagcaaactttttgttgccaatctgacttttagcctgtacatcattggtttcaatggtacaatggatattagtagttgataactgttctaaagtaaggaggagttttgaatgcagacagctaatcaaaatgtaacgttgacggggcgtcgacgcttctggttcatttttacgcaatgttgcttgggacttggaccatgtcgatcagtcagtcttccttgtcgacggtctacccaacatttatgcgcgactttggcatctcggcctcaaccgtgcaatggttaacgaccggctttatgttgacaatggtcgtcatgatgccaatcagtccgtggttgttgaataatattgggtttaagaaattattcttagccgttttggtgcttttcgatattggttcaatcattatttatttcgcacccagttttggtgtgatgatggtcggtcgcctaattaaagcggcggcagttggcgtgctgtttccctcgtatcaatccattttactgacgattacgcccgaggaaaaacggggtagtacgatgggtgtcgccgggttggtcatgggatcagcattagcatctggcccgattatttccggtgtggttttgaagtttaccgattggcacggattgtttgccgtcttcatcacggtggcaactttgttgatcctaattagattttcacaacgatcaaggacgtgatggtcaataagccttcaaagctggatttgctctcaatcgtgacgttactgggctttgctgggattttatacgtcgtgaatgagattggtaaacccaatgtgaactggacgttcggttggctgttattagcggtttcagtactagcggtggcttactttacttatcgccaatttcacttggagacgccgttattggaactacgggtcttaaaaacatttaattatgacttagccattttcctaacagcaatctcgtacgtggcgctgattgtcgtaacaatcatcttcccactctattaccagggtgtcttgaaggtgtcgccattcgtttcaggcatgtcactggtgcctggtgcggtgcttctaagtattttgaacccgcttactgggaaactagcagagaagattggatacaaacaaatcatgttacttggtatgagtatgatcgttgttggttggctgatcttagcactgatccaattcagagttgaacccgctcaccatgattttgctggctgccttaattgaaggcgggaatgcctttgtcatgatgcccgccgtcacattgggggctaattcattacccgatgaactgatttcacacggtaccgctgtgattacgacggttcgtcaaattctcggttcagctggtgtggccgtggcgaccttggtcttatccaacgtgacgcttgctcagaaacaagcgggagcctcaacgttgcgtgcgaacttgcaagggtaccatacggtcttctggatgatgctcggcattgaattggttggcctcgtgcttgcgttacttttgcgtgatgggcgcaagcagtcgcattaataatcacggtgactgactaccaggcgggaatgactgaagttaagtgggatatgctttgaacgctactaattagacattagtgccctgcacaatcggtcggttaggcgtaattaggccaaaagggccgccattcttgtaatcaagaatggcggccctttttcgtggcgcgactgtgatcgtactgaatcacaggacttggcccaactaaccggggcgcttctacttggctgttgctttttgaatctttgccaattgacgatattgactgagcatccagctttgatacgtctgattggccggtaacgtttcggtgaccttcagtactggcacatcgtatttcctggcgagtttgaccatgttcgtgaccaagttactatcggtctgagtgttttcaacgaaaaaggcaatccggtggtgcttgatgtcttgttgcatttgctggatatccttaggtgatgggtcggaaccctcttcaattgcatgtgcgaaatgcgtattgctgattcggtagccgattgccttcaatgagtagtcaaagaccggctcactgacagcgacacgctgattatttgcatgctgtttcaattgtttgatcatagtggttatagtcttagcgttggtctgatacttttgggcctgctgttcccaaaataatgcttgtgctgcggctgaattttgctgagttctgttgcgattttagttgccaatttgggcatcgttgtgggatcgtaccagacgtgttcgttggccccgtcagttttatgagccacgtcggttcccactgtgattacccgggcgcccttggctttgttgacagtaagcttttccatccagtcatcgtagccgaggccgttgtaaatgattaattgggcgctactagcccgcttagccgtgttgacggtcggctcgtagtcgtggggtcaacgctcggtcgatcaataatcgaggtcacttgaccatactttcccgccaccgccttagccgtttgaccataaaagtcgagactagccatgatattaattttgtcgttagtcgttttactgggggtgctcgaactttgacagcccgctaatagcccgctgagtcccagtattattgccaaataaagccatatccgtcggttgaccatgtattgtaaccccattctctttaaatcgtaaccattactgttaactttaccgaaagaaacggtcgtcgtcaagtctttaagataaggtttagactaggtgaaaacactgcactgactgacgaaagctggtaaaataggcgtacctgaaaagcggaaggcggggcacgcagatgatatttacgattgtgattttaattttactagcaagcgcaatttttcgcgggtttcaccgcggatttgtgattgaaatgttgcatctgattgggacggtcgtcgtcctattgtttgcacgactactctatcagccgttagggacaatgattagtaatctattgacgaatttacatttaattgaagcttcagtggcggcaacgttgatcattaacctggtcgctttcttcgtgttaatttcgttagggtggtcagtgattcggttgttaggccgtgtttcacgtagcattacgtggctaccagttattaagcaagtgaacagtgttgcgggtggaatcgtgtcatctcatatttgtcgtgacgtatctggttatttttgtcgcgttgtcgttggcgaacatcgtcaatacgagctttattcagacgcaaatgacgcagtcaccgctcgccacctatattgtgaagcagacacctggtctaactagccattacctcagtaatttgattaattttaatgatgggacgactacggattcctagagttcatggtgggggtacgactgctttaaactaagacaaaggcgttactggttttttgaccagcaacgtctttttgatgaaccggtttgttagcaacgcactttttcggttcccgaacgattgctagtttttatggggttatttggctgattactatcatattgagcgtccttcatgctatgattataagtaaaaatgagcaagaaagaggctgggatacttatgggcatgattcgaattaataatttacgctttcacacgtttaacggggtacttccggaagaacggcgtaatggtcaacaactagggctatgaggatattgccattaaatatcctatcgaaaccaaggttcaacacgatgacgttcacgagaccatcaattacgcggcggtccgtaacgtggtcgatgaatttgtaacgacccattcatacaagttgattgaatcgctagctaaccacttattgcagacgttattgacaagttttcccgcggcggatgcaatcaatattaaaattcgtaaatatagcgtaccaatgcctggaatctttgatgatgtggaaattgaggtggaggggacgccgaatggcaagtagggaagaacgggtttatttgagtgttggttccaatattcatccgcgcgtccaaaatattcagcaagcccttagccgattacgagccgtcaatggggtaaacgtgattgacgaatctcattggtatgagactcaaccgtggggaaagcgtgatcaggccaatttttacaatgtttcggtatccttaacgactaatttgacaccagaagaactattggatgaattacatacaattgagcgggcgggccaccgccaacgcttggttcactggggaccacgtacgattgatttggatattattttttggggcgaccggcaaatcaacacagcgacgctgacgattccgcatgcgcagcagctaagcgcaactttgtgctactgccaactgctgaaatcgccaaaactgatgtgttagttggaccacaagtggcccaattgattgcggctaatcaggatcagagttggattaaaaagtaagaaatgtgagtgagttagatgattgatgagaagaaccaagcaaagattgagcatgcagtacgagaaattttaagtgcagttggtgaagatcctgaccgaccgggattagtagaaacaccagcacgggttgcacgaatgtatgcggaagttttcgctactaagaccgccgcaccatttgataattataaactgttcaaggttgagcatccgactgaaatggtattacttaaggatattccattctattcgatgtgtgagcatcaccttttgccgtttttggcacggttcaagttgcttatgtgccgcagcatgaacaagtgattggcttgagtaagattcctcgcttgattgactattgcagtcaacagccgaacgttcaggagcggttgacagtttccattgcaacagaattacaacgaattattgacccggctgggatcgcggtctcaatcacggcgcggcacatgtgcatggagatgcggggtgttagcaaaccgggtgtgcatacggaaagtagctattacagtggtcaattcaagacggatttagacttgaaacgagaattcttacagcgaatcgcaaagtaggtgattgagtggatacagggacgattgaacaacattatcaggacttattagcccaactaaatcaagccatgttagccaataatcatcagcgtgttccgttattacggcgaatcatggcacatcttggccaccctgaccattattaccatgtgatccatatatcgctgggactaatggcaaaggctctacgggagctatgttagccagtatccgcgggcgcaagggtatcaagttggccgcttcagcagccccgcgattaatgatgcgcgtgaacaactgcaatgcaatgggacgtggatcagtccagcggaatttatcgatacgtatcgtgagattctaccggttctgcaaaatatgggactgacagctagcgatgtctccatctttgaatggttctttctcattagtgtcgtttggtttcggaatcaaaacgtgcaatgggcggtcattgaagccggtttgggcggcttgtatgatgcgactaacgccttagccagtccccaactcacggtatttactaagattgccctcgatcataccgccattcttgggcccacgattaccgcgattgcgcaaaataagtcaaaaatcatcaagccccatacaacagcagtgacattggctgaccaacacccagaagccctggctgttttgcaggaaccgaagcgctcaatcaaggtgttcggctagtgaccgctaagcacgtgcaactgacggtgactgggcaaacactcacgcaaaccgtcgttgatgcgcacagtcagctttttgattggacgcaattaacggtcggactgagtggcacctatcagctacaaaatctgcggttggttttaactgtggttgcggtactacaacagcaacaagttaacttgacgaacagtgcggttcgccgaggcttgcaacaagtttccttgccaggccggttgaccgtgttacaggagcaacctgtcattattgccgatggggcgcataatccggatggcatggcagcactagtggcaagtgtgaagcaattactcgctggtcgtaaattgatttggatcgtcggggtcttacaagataaggcctaccctaaaatgctggctgaactattaccggtagctgacgtcctgattacgaatacgcccgcaaatccagaacgagcgttatccgcgacttaagctggccgacacagcgaccgcattattaacgcccacctttatgaccacggctgcgatgcaacgacagccagaattattgacagcaacgacaatcacggatgcgttaacgcaggctcagcagcaagcaaccagtaatagtgcgattattgtaacggggtcattttatgtcattcgtgagttccaacaggctggttggccggggttaagccaatgacgacgacttggttgatcgcatccaacaacgctggtaaaagtcgcgacttgatcacgtgtttggcttactatggcttgactgctcgtcagtacttgacagtggcaccgcggctcgaatttcccgttgaaacgacgacgagctatgtcgataacgcggttgctaaagctcgttttggggcgcaacagctaggggttccggttatcgcagacgatagtggcttagagatttccgcgttaccggacttgttaggtgtgaccacggcgcgcgacttaggggttgcggtcagcagcggctttgatcgcaatcaggaaattttaacggccctacgcgatattcctaacaacgagcggcaagcggtgatgcgtgctacgttagcggctgcctggccagatgggcggaccttgaccgtacaagcttcgatcatcggctacatttcgtcctatcaatttggacgctattctggggatttgaccgaactttctggctaccgcgttatggtcggactttggccgaattaccagcaacgtggcgcatcccgctgacacaccggggacgggccgccttaaaattaatcacaaaactttaaaaattggaaggatcggtggagtagatgttagtacaagatatcaccagttcattagcacaagcaacggattttgcgagtcaggcgttgaatgttcaagttcaacggcaacaacaattagttttacgttttagtgattataatcgggaacaacaactccggttaacccaactgtgtcagcaattagacggcgttgttcaggcaagtcctgaacaattgacggttttattaaatcaagcggcgggacggcagttagcccagcggtggtcgacagtctttacagatcaagcgaccgttcaaattcaattaacgcaaattatgaaacaatacgatattttctggcaagctggggagcatcggttcaatctgacgaaaaagccaatgatctacggtatcatgaatattacgcccgactcctttttcgacggtggccagtataagactaaggatgatgtactcaaccacgtggatgcgatgttacaggcgggggcagatgtgattgaggtaaacggtcaaacaacccggcctggctttactgaagtgaccccagaagtcgaattagagcggacattaccttatattcgggcaatcaaggaacggttcccagaagcggtgttagcagttgatacttacaagtatgatgtcatgcaagccgtggtagcggaaggtgtcagcattattaacgatgtgaatgcttttacgatggatgatccccggaagctcaagttactagctgatagtcaagttggtttgctaacgatgcatagtagtcgtgaacaggagtatactgacttgacgagtagcatgcgtgactttttcgaacaaaatctggccgcgctcacgagccatggaattgatattgaacggattgctttggatcaagggattggctattcacaagttgcacatggtgagcaggactacgtgatgatgcggaatattgatgaatttaattatttgcggcgcccaatgatggtggctatttcgcggaagggctacttgggcttgttgctaggattgaagaaggaagatcggttaccgatgacgcttgttaccgaagcagcgatgatgcttaaaggtggccgcgttattcgagtgcacgacgttgccgaaactaagcaattaattacgttgttaggtcggattgagaatggctattggttggcaactaatgattagctcggatgatttcaatgatattacggctaacggggtcgtagattacgatgcttactttggtacgcctacgcatgatgaccacgtcttatttgaattattagtggtcggtatcttgcaagtaggcttaggctggcgagtcgccgccagtcagctaccagtgttgcgacaacacatggcgggattacgtgtggatgctgtcgctgccatggatgagccggattttgaacgattgatgattacgcccaaagtgatgcacaatggccgtaagttacgtgcaattattcaggatgcgcgcgccattcaacagttacaggctgagtatggtagcttcagtaactacctgtgggcgtttgtcgatgcgacgccggtcattatgccggcgcccgatgatgaattaccgacgcgctcgcccctgggtgcccgcgttgcgaaggatttacatcggcatgattttaccttcgttggaccagtcgtcacccacatgtttttgttggcggcgggattgattaaactgaattagtcagaattaggctggcggatgctagcctttttgtttggggcgaattgtcaaactaagtgcaacggtttgtcaaaaatacttcatatggggtttcatagtttaacactttgcgaggacgttgatttaactgcttttggcagtgttcaacgtcctgttctgtataattatcaatatctgttcgcttgggaaaatattcccggattaacccatttgtattctcatttgttccacgctgttcaggcgaatatggatcgggccaatagacagtaacacctaacctttcgctgatttcatcaagatgaagaaattcggtcccatgatctggtgtaatagaatgaacaaattctttaggaatgacccctaacaggtcaactaagcctttatttatctcccgcgagtccttttgcacaacctttttgataagcgtaagccgactaagccgatcgacaaccgttaaaaggatggagtgacccgttcgaccaatcacagtatcaattttcccagtcacctatacgttgacgctggttgataaaaccagggcgctcatggatcgagatatagtcggtctgtacttctcgatgtcgtctagtattctttgaatgccgagtccgatgtttatgtctgagatggcgctgaataccggtatcaccacgtgaggagtacttctcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattaccgcacaacgttttaactcccgtgaaatagtgcttggatttcgccccagccgtaacgcaacagcccggatagataaccccttagctcgtaaaaaaataagtattttcacgttcttttatagtaagatgtttatagctcataccggatacctcgaattgtttgatttggtcgttaaacatattctacccggtatgggtttatttttttttactttgtgttgcatttcaattgtaaattcgccggggactaaataaccgttcctgagtataaaatgatgacgaatactcagatgtagaaaatataaatgggtatgaccgaattagtacctgatttagttgttattgaatgcaatccgtattgtgctagctagttattatgaatcgtgattaaaaccgggcaacttaggtggattactgttcgtcagccgatgttgatttgagctcgagcaacccccgcctggactcaaatacaagtcttatttgcgctataccatttggagttgataagcaaatggccttgaggcacctttttctataccatttgatttgttggattcttgaggacgccaaagcaggacattaacatggcccaatttgctatctctcaaatctaccacagtaaaagtttagaaaggatgtatcaataatgttccttactagtcgctagtcggtctatccgaaatgtactcgaaataaaagacttaaacatcaaattttacgaagattcttacctgaaaatcgttaatggatgcgaatctttgattatcccggccgttttggcctatttaccgccacgttgtaccaattgtgtcttcgacaacctagttaaaaacggttttaacgctaatataatcattgtgccaatcgaccaatttatctggttttaaagcgtcagcggtttttctatcgaggatactacacaacttttgacgcgcagatcaattatatttggcaaaactatcagatttcacaaccagttcgttagttgattcttagtgaaaccactcgaaatcagtcaaataaagacattgatcaacttcgacaagacagctcaaagaacctttgacgggaagctagccaacatcaacaacacgccaaagatcaactcaacctaagcacctggtatttgaagagtttgcctcagtaggtaaaaaagagctttatttggtgtcattccgatttattgaactagtcggtatatcaaagcgtactttcgcggtttctcgccaaaattacgtatgaatgccgtttatactaaattggttcccgaactctttcctggtaccaaagttcccagattatggtggaccgtttccacattatacaaatggcgaatcgcgccttgaatcaaattcgtattcaggtgatgaagacctagacaagaccgataaaaatataaattcatgaaacacgaatggaaacaattccttatgaccccttgagaaattagagaaagtcccgccacagtatcacaagggtgtgggttattataaaacctatcgagacattatgccggctctgcgtacccacgatacggcactatttgatcagaccttacgtgcttatcgacagcttgataactcccaatgaatacaacaattgaaagtttgtttaaaagcatcgtaaacaagttctaagtgccgttggatcaccgtattcaaacggttatttagagggaactattggcggaattaagaaagttacgaacgccacctttggctttcataattagtttaattatataaattgaatcaagatccaacttcaatgactgcatccaatacgacaaactgtgagaaaaagcacctagaccaatttaagtccaggtacttcataacaattttatcaacttcacttgacgaaaagccattttcatatatttatctaatctgaatccgttgtttatcattcatttatgtttacaagaatacgcccgcgagaagccgtttcgtcttcatagtgttgcgccgcttttacatcgttgaatttaaaaattttgtttatgtgcgctttaagggtgccatttgagagcatttcaataatctccttatagcggttaggactaatagggttattgttaaattcgctataaatatcgattcgcttttttttgatatgttggtaaagcagaagtgaataaagttccaccttcgaacagtttattttcagcttgattaagcagtgtttcgctaccagctgtatcaaggacaaaatttacggagttattggaaattaaatcaatatcactgacaacttgagcgcttggaaagatactttttgtgtacttaaagcttcgtttagacgaaagaatggtaacatttgcttttagggttaatagcatctgatacaaatagcttccaatactacctgatgcaccaattaataagacaatgtcattaggatgtaccccaacgctttgaatcatcatcatggcagtatcagctccgccgaagatagttgcgccagcttctaaagacacattatccggcaaaaaaaaacataaggcggaattgatgcgttgataatttctgcgtaagtcccatttgggctggcaccaaccacgcgagtacctcttgttgggccgaaaatattattatcgtggattgtcttcccggaaaatccataaccaagaatctttggcagagagctagtgtgcatctgagtcaaaagccctttttcatttttgatatcccaaggcaaaacgggaacgtacttcacatctactaaagcaccgataatactacttttgggggtggaaatgttgacggtttgaatcgaatcaataccattatagtctttctgaattactgcatgcataaatattacctccattcttttgattaatgctaatttacgctgtatcggcaaattttaaaaataagaatactgattttataaatttgattgaaagcagcatactaaattacatggaggtgataataatgccaatagttatcttactaatagtcgtgtttggtattgcaaaaatatttactttaagttattggttagttttggaatggacaggaggaattttgacagtaatagtgactgttaaattaattatggctctattactgagaaaaaaattttgaaataataatggccttgattattagtgcttccttgaagactggtataaaacagaaataggaattaaagcgccccttgagtttggatttactcaaactcaaggggtgctttaattaggttttctgttctattttttattcgacggttctaaatacgactatttctttgtttcacagaaaaatcagaatactaatatcaaatatcatgattcgaattatgttgtcaggtttttagggcgtactatcgggttaatcggtagcgtcaagaatcttgtgtaaatgaaatgccttcgtacatataatatgtatctaacttaaataaatgatgcttccaaggtgtcctggagtcctttgaaccctcggtggatccgcctcagagacttctcgttataaacattaaactgagaaaccagaaagcgatccagtgaatcttccgttggaaattgttctttgtggtgggtggtgcgcttgagatgcttattaaagttctcaatcaggttagtggagtatagtgattgcgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttggggaaatgccgattcaagccttcatccaaaccaactaacccatcggccacaaacaacagcacatctttaacgccccgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggcagcgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaattgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaattccagcgtatgagtagcgttcgtaacccaaaaaccccgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctcggttaatcaaaagaaaggtggaattcaaaatgaaattctcaactgtagatgaagcattaactcaattaaaacatggcggtttaattattgtctctgataacgaaggacgtgagaatgaaggagatcttattggattgggatctaagattactggagaaacggtaaactttatgattactcatgccaaaggactgttatgtatgccgctatccgcaaaacttgcagataaatttgaactaaagccaattgtagacaaaaatactgaaattaatggtacagcgtttgttactacttctgatggttcgtatcaaacgactggagtgactacgggtatttcggcttttgatcgtgccagtactattaaaaatttgctgatcctagttcgactgtaacagattttgtgcatccggggacacatgtttccgctagttgctgtaaacggaggtgttcgagaacggagtggtcatactgaagcggctgttgaacttgcaaagttagctggagagccggaagtaggagccattattgaaattattaaattagtacctataccagatattcctctttaatcgataaaaatatatctttgcaattgaaacctgacaatcagattagtggtaaagtgtccggtttctctgaaaagggtggaattttaatcacaaataatgggaaaacgactgagtatcaaataggtgagatcataagtgtaaactaagtattggccattgccttagctttttgtagtacatcaaaataaggagtctagtatttcctgttaatggtcttgtacattataggttgataaccggagagactagattgtataaagtcatttctttaaggaagtggcttcttttgttaagcaatgttagcagactaagcggatggacatagtcaggttaaattcagagtaatcagtgatcacgtgacagttaaaccaatacttgataccaagtattgaagtatcgcaaaagtgttggttattataaaacaggccttaacctcataattgagagacgcgcattgaattataattttgaaacggcctatgaagcccatcaaaatattatggcagctctgcgtacccacaataccgtgccatttaatcagtttttacgtgttaccatcaacgacaattaaaagttttagaaagcaccgtaaatgagttataaatgtcgttgaatcaccgtattcgaatggttgtttagaggctactattgacttaattatatcagccgcatcaagattcaacttcactagctttatccaatacgagaaaacgcaggcaacgaaaaagcacctagagcaatttaggtctaggcgcttcataacaatttcgtcaacttcacttaacgaagagcggttttagaatgatttagttttgtttacctttgacacgactattagtacgtagtcgtcgtgtctggtaatagccacatcgtcaccaagccaattagccaagctactaggaaaaagcccattgcagctgataattggtagccaagcaaccattggcatagtaggataagtgtgataatgatgccgataacgcgattgatgttggtcatgagagtgccccctaggtggttagctaagaattaaacgaaccagtttatctgaattaataaatattacttgaattatataatgaatgatgtgatgtgcgccaaaatgtgcgttaatgtcttaatttaacgtacgaacgtcgaatattttgaataaaataaaaaacgataccgttagtgtttcggtatcgtcagtaacaaaagtgtactaaatcgaactatctgtcgtctcatagtccaccttgccaagttcaatctgaatcgtgatgtgggtcaatggaaactgggcactcaagtccttattcaattgttccaaaaggcattattgtcagccaatgttgagcgacagagaggtggacggtcatggccgtttcagtagtactcatgccccaaatgtgtaagtcgtgaatctggttgacggtgggctggctagttaaataatcagcaattgcttggcgatcaatgttatttggtacggcttccagtgaataattcatggcgtcccgtaaaagtccccacgtgccaatcaaaatcacgacggcaattagcgggaaactacggggtcaagccagaaccaaccagtcttcaaaatgatgaaaccggcaatgaccacgccaactgaaacaccagcgtcagcagccatatggagaaatgcgcccttaatattgaggtcgtgtttttggcccttcataaagagcagcgctgtaaagccattgataacgaccccaacagcggcgacaataatgacatcccattcagcgactgggccgggattactaaggcgctggatggcctcgactgaaatggccccaatggcgactaataaaaagacggcgttgataatagggcggccaagattgatgagcttttatacccatacgtgtacttatcgttggcgctttttgtccgagccagattgctaaccaggagatcagtagacccaggacgtcactgagattgtgtcccgcatcagcaactagggccaatgagccgctggcaaagccgtaaccagcttccaagacaatgaaggctgtatttaacgcgacgccaatcttgaaggcgctggtctgttgttgtatttgatggctgtgtgccatatgaatcacctacttcttagttgaatttatccttgttatggctataatttaaatatgaatgagcaaacatatgaatgtctgttcatgtgtattgtaacacgcttacatgacaatctcaattagaaattggagtttatgatggaaaatgaaatggaccatgaaataatcgtcaaacggttggccgaactgatgccaccgactgctgagctcaatcggatcaccgcaatttttaaggcgctgggtgagtccaacccgcgcccgaatcatctacgcactggcagtatctaagctgagtgtgggtgaattggcgacaggattagccctgacgcaatcgaatgtttcacaccagttgacagtgcttaaacaattaaagctggttgtcggaacgcgcagtgggcgtaatgtgcactatcaattggcggataagcacattattagtattttccaacaagtagcggcccacgccgaagaggctggcaattaagttgaatatgggggcgtagcgctcatctggctatgtgagggccaactttcatgaattagcgttacgagttgaactggatgtaaacggcgcccataactttgaatggttgcccgctgatagcggattgtgcttagcacaccactgcgaaaggactaatttcacagtggtttttttgaatacattgcgattttattaattacctagttttataaactagatgtattgatatttacactatgtgatggtatgctggtgtcaataataaatatgaggtgattaacatggcacagtcggcgcgacagtatcaaataacaaatgaagtcctcaactcagtgactcatgggattgggattattttaagtatcgttgcatttgtttttttgatgctcaaggcatatgcggatggtcagcccctcgaatgggcggcgtttattatatatggttgttcgttgtttgtactatatacgtgttcgacgttatttcacggattatactttacgcgcgcccgcgaagtttttcgtatcttcgatcacagtggcgtgtacgtgctgattgctgggacatacacgccgtacagtctactggcgattaagggttggttgggctggaggatcttattaacgatttggattttagcgattgctgggattacggttaatgctgtttggcctggacgtttgaaaaaggtcgaaacggtcatttatgtgttgatggggtggatgtgcctcgccggtggtcggcagttatgggaccatttaggtgtcactggcttctggttattagttgccgggggcgttgcgtttaccttaggtgcattactatatagtttcccacggattaaatatttacacgttatttggcacctattcgtgatggtgggaaccacgttgatgtttttctcaatttatttctatatttaaggatgactgtggggaccagctgctgagttggtccttttttttttttttttttttttagatgcgggagatttgagtcgcggatgacgtcttaaatgctgattattgacattttattgcgaaaagtttttcaactggacggtattcgaatcgtaaccattgcgtacgctcgttaagctgaatgagttatcgccactcagctaacaataattttgaaattaaatggctagatcgctgtagcatagtctagaatacgatttatttttgtcatcaaactgtaatcagccaggcgtatcttttgattgcctttttaaataaacttccgtagaatagtaggacaacgaaaaatttttagtgaggtgattaagatggcatacgggttattatttggtggcattttcatggaagttttagggagctttttcttaaagcgcgcaaacggttttcggaacttaataccaacgataatggtgttggttggatattttagttcgttagtccttgtaacgcttgcaatgcaacgcccgccgttaggggtgacgtatgccatgtgggctggactgggcacgtttgcaaccgttattttagcggtcgtcgtttaccgtgaacggctcagtctctcacgtctgagtggcttaattgcaatcgtagtcggggcgattttactgaacatttaaatcaagggggaatgatgatgcgtgcatggattcaattagttattgcgattggcgttgaaattgcggggaccagcttgttgaagttatcggctggatttaagtaccccttggttggaattgtgggcatgttactatacggcctagcgatttttagtttctcacgggacattgagcaaaatcccactgagtgttggttatgcaatctgggccggagtcggcacagctgcgaccggcctgattggaatttgggcgtttggcgaaatcttgacgggattgaaaacgttgggattcatggcgattattacgggtgtgattctattgaacatgcacgctaaggcgactaaaccggctactgcgacgccgcgcttggcacggtggcggacccggtttaaccggtaactaaaaagatcgagaatctggctgatgttttaagcgattacgcttgaaatgcgccggttgattctcgatctttttagttgttgtaattaggcttctgaccagacttccttagccgtaccaatgactaacgccaacttggcccactgttgagcctcagttaactggttaccttcttcagttgaagcaaagccacattgggtcgatagtgctagattacgcaatggcaccttagtggtcgcagcttgaactcgttctttgatcacagtggtcttttccaattctggaaacttagaggtaaccagacctaatacgatgcgtttgtggtcatcatggttccaaatctggtctaacgcttcgaagccacccgcccgttcgttatcatattccaagaacagcccatcatagttaagctggccaaggtagggtgcaaccacgtcgtaactgcccgagaagaggtacgtggatttaaagttaccccggcagatgtgggtcgtgacggtcaagtcgcttggcgggtcagctaatgctgcgttaatcactttaacggcatcggtcgcccacttagtgtaggccgcgtggtcagcttcgggatcattgagtttgctaattaagaaagcccacgtcgtatcgtctaactgaatatagcgacacccaaggtcataaaaatgttgaatggtatcgtgataagcttgggcgagatcatttaaataggcatcccagctgtcatagaatttggtccaattgtcactccgattatcacggaataacacatagttggtgatggaatcgtttgtttagcgagtacgccagcgggaacgattgattgtaagtattcaaaggcagcaaagaacggatggtcgggattatacgcgactttgccaataagttcagcgttatccgttcgagtatggtccccttgaacttatagctttgatggtagtcgtacttgccaacaccagttaagccccaaaggaaatctaagtgccaccagctgcgtgaaaattcgccatcggtcacggctttgagcccgagtttaacttgttcagcgaccactcgtttgatttcagtgtgttggatttcaagttcttgatcacgcgtaatggtaccggcggctaattgttcatgggcctttttcaaactagcggggcgcagtaggctgccgacgacgtcaaaacggaatggggcggttaaagttgtagttgtcattaaatatcaaactccttaaattttattgggaacgaaaaaacgtcgtcctgaataatattaatcattattcaggacgacgttgggccgtggtaccacctgagttctaggctagtgaactagtctactcgatacagctgccaaatgattggcaattgctaacgcgggtaacggttgttaaaccggctttagttaatgctggttactttgttgctcaccagacactcaccaaaacgaactaggagaagaccatcttcattggttgtgccggtaccgtttcaccaacccgatactcgctgaacagcgacaccaattactcatcttttaatcgttctttaattattgacacctatcatactggtaattattttaaatgtcaaatttaatttaaggccggaatcggtgggcgggattaatccatagtcatgctataatgcaagtaacatgcgattgggggcaaattatggatagaatcattcggtttttaagcgggatgacgttgacttgtacttaacgttggcgttattaatcatcattatttatttaatgcgcgggtttggcgcgacagttgttctattaacgacgatttttgcgtatttgggcattaagcttagtcggtggttaaacctccgaacgcacttatcttattggattgccgtcattgtggtctacgtcggcgtgattgcgttgtttatcggtgcgctatcgtacgcggcgcctaccctggtcgatcagttgaaggtcattccagatatgctggctaaagcaatcaccaatcacccggtattgaataagaatattgataaatgggtcaaccaagccattcatagtagtgaattgattcaaaacgggaaggcgttactcgtcaccggtattaaaggactgagtgaggttgggactggttttacgcacgtcttaatggcaatctttttgagttttatctttgcagtttcgcggggacgaatgatggtctttggccgccagttcttgcagtcgaagtttaaaaagttcttcacgaacgtttactatttaacgcataaattcgttatgattctggggcgtgattattgaaacgcaactggtgatttgtacgatcaatacgattttgatgacgattgggttcatgattattgggatgccaagtatcatggtgttgtcgatcattgtctttatcttaggcttagtgccggtggctggcgtgttgatttcaatgattccgctaaccttactggggtttgcgtcgggtggcttgattcgagttgtctggatcatcgtgttggttattttgattcacgccttcgagtcttatttccttcatccacggctaatggcggatcggactgatttaccagtctttgtcacttttattacgttgattattatggaaagtctattaggggcctggggcttgatcattgggattccaattgtttcattcttcctagacattttgggtgtgcagaattctgagccgcgacgcgtgacgtctcaaatagcgaaacgtgaaccttagtgtgattgtaactgtactttaccggtagcagactttgtatggggtcgggtgatttatatgaacagtagcttgtgactgcgcgtaaaggttatcaaagataattgtaagctggtatcttcgaagtggattactttcgaaggtgccagctttaattaattactgcttaaagatgctgatagtgacaattacaagtcagactgttagtgttaagctatcagcgttctaggtggtataaggttgacttatttcgactaagtgttagagtgagcggttggaatctgtttaggaggggcgattacgattaatcaatcaaataatcaacatcccgtgttagatggctggcaagaaattgaagctgaccaaattaagcgaatgcaaggtgcgttgtggcatttgttgggcaatgcgatagcatatttaagtctatttgtaatcgaactagtgcttgcaacgattggtcattcgcaatctttgcacgcggatgcgtttaataattttgcgggtattgtttcatcggggttgttatcgcttggtatctggggtggcacttcataatcatcaatcacatcaaagtaaagtgaccgctttggacggctgggaggccgaacgtcgcaatcgattgatgcgatttcgtttacaagacttattcacgttaatgagtggggtcattatgttagttatggcggtacaagttattgtgagtggtgttagtaatttgtttaaatcacacaccgttcaagcagtgagcggtgtaactgtttgggagctgcaatcgcgagcatcgttatgttagtcgtctggtactttaatcgtcgcggtgggcaacaattagataattcgacgctattggctgcggcaaaggatagtcttagtgatgcgttaacgagcattggcactttaatctcattaagtggggtcttactattcaaatttgcttggttagatagtgttgcgagtatcgtgattggattctttatttttgccgctgggttacaaatttttcgggacagtgggttgcagctaattaattacagtgatccacaagtttgaaaaaaattatattaatacgattcaacaaattgatggtgtgaatcaggtcaatgcaattgatgtccagtattctgggagcttagtggccttgtcgctggttatagcagtgtcaccacgaatgacagtggcagccagctttcagctcagtgaaagaatcgagcaagtgatgcgaaatcagtatggcattattgacactaaggtaatgtttatgccgcaaacataagtgtgttgactgatagattttaataataaaagactagtttcaaggttgaattccttgaaactagtctttatttatggttggcgcgaattccgttgcggcgtgcgggcatggtggaccgtcaaattcgttagtgtggcgtctgttgctggtttcgtgaacaaaggaatcgtctcttccaagacatcgctaaacgctaagccgtaccagatagcgaggagatggggtgatgttttgtagtagaacgcgaccaccaattagtagtcgatcgaactgggcccatagttgggttgctagcaaggtccatgatctgctgattctgaacgacaaatttaaaatcgccaacttgacgaggttgtgtgattccgtaacgggaatattggggatcgatgctgtgatctgcaattaagttcgtgacaatttggcgcaaatataaattaatgtgctgtgatttacggaaacctaagttgagttgaacttccacgatatttcgagtgcctagcatgtcaatgctgtaactacaatcataaggtcggttggtttcattaatggtaataaaccagtaaaccttagcgcgtttaggccgcttatctaaaatcgagtacagaattgaccgtttaacccggtgttgatggtcgaccttagccaagtagactaagttcgttgcaaatactggcggtggtgatcatcgtggcttagctggatcagttgattacgataatctagcagactaatctgttcatttgcctggttgtaacgcaaacgccggcgattaccaaaaagaaccaaacgaccataatcaagaaaatgacgagggtcagccccaaggtcaaatagccaccgtgaataaacttggtcagactagccgttagaaagacggtctccagtgcgccaaagccgaataataaagctagcgccagcgcccggtggcccttcatgtgaatccactggctaagcgggatggtcgtcatcaacattgttaaggtgatggctaaaccatacgccgcttccatgtgagctgaagtttgaaatagccaaacgattcctaaggtgaccagacataacagccagttgatcgcaccaatataaatctggctccgaacgttactggggtgcttgataatcatacgtggtaagaactttaaaccgactgcttcgtcaactaaggtataagagcccgtgatcaaggcctgtgacgcaatgatggctgcggccgtggctaagataatcattgcaatttgaccgcccgcgggaaccatggcatagaagggattgacattggtggcattgcgccatgccgcatcctgataatgggttaacatccacgcgccctgaccaagataattgagaatcaaagtcgtgtatacgaacggccaagtggcgtcgatgttggctttaccaacgtgacccatatcagaatacagcgcttcagccccggtcgttgcaaggaagacactaccaagaatgaaaattcccattttattagccggattgaataagacttgtacggcgtaaacgggtgagaaagctttgagaatgacgggtgcctgactgatgttgatcagaccgaagatgccgatgacggtgaaccagagcaacatcatgggaccgaatgaccggccaacgacggcagtaccaaacccttgaatcataaagagaaccagtaaaataaccgtaacggttagaggcacgagccacgggtactgggaaaaagccccagtttgggtaatccctttaagccttcaactgctgatgtgactgtcacagcgggtgttagggatgccatctgctaacaaagcggcgccaccaatcaacgcgacgaaaattaaccatttggcccggtgacgaaccagcgcatacagggcgaaaatgccaccttcatgatgattatcagcgcgtaaagcaatcaggacgtactttaccgttgtaatgagcatcaacgtccaaaagattaatgaaacactgccgataacataatcaggtgttgcattcttaagttgccccgcgtcattgatcagggcgttcataacgtatagcggtgacgttccgatgtccccgtacacgacgcctaatgtgattaacatgccaatcaatgaacgttcctgaatccgttgcttacgcatgaattattgacccccacttcaattagaactgtgactcatactatactagcttttttcaaaaggggttaaccagacaaactaaaaatttgctcatgttaacaagtttcaacttacgtttcgttaggtgaactttacttcaagttgagtacaataagtagtaatccggttgttcgtatttagaggataaaaaatgggccgtttcattccagttgataacgctgaaatgaagcgacccattagttttgaatttattagtctagtcaattatttctcatcagtggctgtattcgtcttcaactgggagtgtttaacggaatagccaaagtaaacgaccataccgatggctaaccataccacgaagcgaatccaagtgacaggcttcaggttgattagtaggaagacacaacagatgattgacatgattggtacaaacgggacccatggcgttttgaagggacgccgaagatctggttgtgttttacgtaaccgtaagatggagaaggaaactagggtaaaggcagtcaaagtaccgatattcaccagttcagctaagtcagctaatggaatcaagccacccatgattgcggcaatcgacccaaacaagacggttgatttaagtggtgcaccggtcttggcgctaatatcgctaaagacatggggggagtaatccatcccgcgacatggagaaggaaatccgagtttgaccgtagagacagactaacattacagtggtcataccaagaatcgcgccaaggtcaatgattccggccatccaattttgaccggagtaaataagaacggccgagatcggatgatcaatgtacttggcaaacgtttcaaatgggaccacgccagtcatgatggctgatacagccacgtagagaatggtacagataccaagagacagtaacatggaacgtgggagtgttttggatggttccaatgtttcttcaacgctggatgaaatggcgtcaaaaccgatgaaggcgaagaaaacgctagaggctgcgccgaagacccctttgaagccaaatggtaataacggactccagtttgccggtttgatgaagcgcaccgcggtaaagatgaataaaagaacaacggctaatttaatcactaccatgacgttattgacgcgtttagtttctttgaccccgagagagacaataaagtggtaatcaggataataatggtgaaggccggcagattaaaatagctggtcacaccagggacggaacccgcagctgccgacaaagcagcgggcagtttgaggccgaagcccgccaagaatgattgaaagtagcctgaccagcccgctgaaacggttgagacagcgaaaaggtattctaacatcaagtcccagccgataatgaatgcaacaatttcgccgagggttgtgtaggcataggtgtacgctgacccactttcaggcaccatcgcagcgaattcagcgtagcagagtgaagcaaacaggcaagcaattgcagctaagacgaatgagatcattaggccgggacccgccgtcaaggccccgtaccagttaaaacgaagatcccggtcccgatgatggccccaattcccagcatcgttaggtcaaatgttttaagttccttttgagcggactgtgataagtggctaacattgcattgatatctttttgcggagtaaccgcgtgtgtgataaatccataatcatcgccccatttcgatgtgatagctttagtttaatcggttttgacaaagttacgatggtcaatccgaccaaaataaatattctgatgggctatagtgactaaaagccaaataattggacgcaatcgcgcgacatcctgcgacttcttattgattgtctgactaatcgtgattaattagctacggtattcaacgcctattaatagggtgatatagcgaacatggcggggattgtttttctgaaggttaacttaccttgtgattgcgattgttagtggggattattgaaggaccttagaaaatatggttttggctcactaaatcgccacttgattgatgcaacctgaagaactggagagagtgagcggcttattggaaccttttttattgatatcgattatatgaataaaatgggattatgattatccttaaagtattttgatgaatcaaattggataattaatttttttcttgcaggtaaaacggcctacgggaaactgatgtgactcgtctcgaccttccaatatcaacatttattgaccacatttgcataaattttattattccaaatacaaacttgattgcaattctaaaattaacaaatacgaatgatattcattagttggtgacaatgggtttggcgtttgctatattcaaaaggagaacgcaaatcaaggcctgaccaatattaaaggccacttgaaattagtggactactgggtctgctgattgttgctggtatcgaagctagtgattgcaatgactggcagatcttgaatcaaaaaggggatagcaagctgattggtttggtgttggtaataaaagtattgatactagtacgtctgcattcataatgtataaagcattgccagactatttccagataataaagttgggaggcattagtcatgtcgtcatttcttaaagcaaagaccgttacacattacgtgctttttgcaattatcccttattagtagcttctgtttatacgggtacgttaaaaatcgtattgagttaaatcaagcgaggactgtactaacaacaatattaaaaagcagtccttatgacgtgcgtgtctcgagaaacacaataatcaaggaagaatccggcccttttagcggcattatttggtatgaatacacatttgcaaccagccaaacattagcggaaagtaagaaatacaaaaagtttttgcatcagtcatcaaaaaatatgaccctgaaaaattgccccatcgtctatcgcgtaatcgttagaccgccgactaaaaaaataaagcattggacgggtgaaatctatctcgataccaatcaaaaactcagcgcaacgggacgttcgaattacgtccaagctttaagcgacaagtctttgtgtgaactaacgatttcataaaaagccattaaccaggtggttccaatgatttagtttactatcggcctacattgaaaaatggggtaggtaatgcgttaactcaatcaggccatacaacagatgttcagaaggggtggtcgaatcgagttgtgttgattgtctaatcaacgcaactttttatttgaggatttaacttggtcaaaaatatttgttatgagtttctccagtggtagcagaggtatactgcaatgattgaataaaccgatccgtaagataatgacccataaaaaaacagctgggagacttcaccagctgcttcaaagatttgatttattaacgatgtcgtcgatagtaacggtagacgaccgctaataaaataataattagtaaaataccaacggccgctcgcggacccgcaatgtgttcggttaagtgaaacatgcgaatggggccgaggccgtgaattccaagcattgcaagcattgaacgcgccctccttaagcataattattagctatttaatgattaaatgcaaaaattatattcgcaaaagattattatctcactactatctgcggtaaaataaaaccatcattaataaattaggtgggtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcctttgtcggtcgtaagttaccgaaaaaccggttattccggttacgtaaagagacgcaaattagactcgaacagatgattcagcggcaacgtgaagccctgggaacggaattgatgcccgcagatgcggtcactagctcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagatttggaaatgaattattacaccttttagaacggaaagcagcccaaggcgtcgacgttcgtgtcttgtatgatccgtgggggtcgatgggcacgttccgcagcttctttaagcatttagaagaacttggtgggcatgctcgaccgttcttgggtgctcattcagcgattttggacttccgtctcaacttccgtgatcaccgtaaaatcgtggtaacggatggccgggtcggctacgtcggtggttttaacgttggtgaccagtaccttggtcgtagtaagaagtttggttactggcgtgatacccatttgcggatcgtcggttcaggagtttttgaattgcgggaacgtttcattcgtgattggaacgccaccgatgcggaacatcgaatcgtgccagacgttaatatgttcccagtcattcgcgttaaagggaatacttcgttacagatcgtctccagtggtccggacagtgatgcacaacagattaaattgggttatattaaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaactcagtactatgcccgggagctggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgatttagcacaagaattggaacggattttcttagaagatcaaaaatcagtagtttgattaccgttcaagactttaaaaatcaatcattctggttgaagttcaagcagacattttcacggttgttatcaccaattttataattaaacaattgaatagatatgatgcaaaaaaaaactgattttggaaagttattgactttcaaaaccagtttttttagtattccttagtcgttcaagtacaattggcgcaaattattaatatccgctacggataacccaagcacttctcgtaaataaccaataccattgccgtagaggtcgtcgaaaacccgaaagaccatcttcatattgtcggcttcaacagccatggcaacgttgaattggctagctaggtcaccagcattggccttggtaatgatcgtagcggtatccatactgtctgcggccatgaagacggcgttagtgagcgggtagtctgcataatcgtttcacggggacgtctagggccgtcataatgagcgcacccgcgacccccgttcggtctttaccagcagcacagtggaagagtaccgattggtcgggctggtcgttggcgaggagggtcgcgaataaattttgccagactttcacggcatgactatccgtaatcatttgcgcatatgttttcagtgcgttgaaggaatcatcgacgaccattcgcttgatgagcctttttaaacggtgatcaaagcgacgattgtcagtgaacggatagacggacgtgttgatatacttagtattcttgggataacggtctggagacatctcagcttcattggcttggcgcagatcgatatcataacggagtccatagttatccaagtaggtgagatcgcggttagtgagtagtgacatgccaccgcaacgcagtagcttttgccacttgattgtctgaccagcggtgttctcataaccacctagttctcggaagttaataccgtgttctagtcgtaagacccgattgtgttccatagtctgattacctcgattagtgatttaactttattataaccgctttcattgccggtgtcaggtgtgattaacaagcagtcgttaaagtcacagccaccatttttaagtaggcatgttggtttggaaacttcacaacagaatcattgtcaaaatgtaactagccgtcacgacgaaaccttagtgtggtgggatttataaaacgatcgatgagattttgacatgaaaataatgagaaaacatcttgaaatcaaagcgctaaccgcttatgattgcggcacgtatttttatttagtatcaactaacgactatacaaaaggatggggacgcaatgggagcaaaaaaaggctggttggcagcaaccttctttgctggaacactattactcgcggggtgtgggagctccaaggcaagtaatcagaagcgaggctaagactgaccatttcaactatgtgtatgtgcgggatcctgataatttcgattacaccgtttcggcaaagcagaataatacggacgtggtatctaactttgaagacgggttgcttgaacggaatccgtatgggcaactaactggcgacttagctaaatcgtggtcggttagtaaagatggcaagacgtacacctatcacttacgttcgggggtcaaatgggtcgatagtgaaggcaatacgcatggcaccgttaaggcccaagactttgtgaccgggctaaaacacgcggttgcggcaaagtcggagcaattatacgtcgttcaaaatagcattaaagggctcgatgcttatgcgacgggtaagactaaggacttctcaaccgtgggtgttaaagcacttaatgcgacgaccgtacagtatcggttgaataagcctgagacgtattggaattccaaactaacgtacggcgtgatgtatccaattaacgcgcagttcttaaagcaaaagggggctgattttggtaaggtgactgcggatagcatcctgtacaacgggccatacgtgcttgccaactttacctcgaagtccgtcttgaagtataaagctaatccggggtattgggataagtcgcacgtttatttaaaggcgattacgcttacttttgatgatggcagtaatccggatggcctttataaatcgtttgagaagggcaattacacctatgctcgggggtttatccgggttcagctggatataagacggttttgaagcagaacaagaataatattctgtggaccagtcaggattcgtcagtctataacttcacttttaacttgaatcgccagtcttacaacgataccgccaagaagactgatcaacaaaaggcggatacgcgtaaggcaatcttgaaccagaatttccggttggccgttcaatttgcatttaataaagctgattacaacgcgcaggttaatgggaagattggcgctaataaggggttgcgtaatgaattaaccccaccatcgtttgtttcgattggtagtaaggattatggcacacagcttcaagaagatatgcagaatactgattttagtgatattaagttggcagatggtcaggacgggacttatcaaccgacgaaagctaaacagtattttgccaaagcaaaggccgaattgaaagctcaaggggttagtggcccaatccatcttgacttgccggtggattagaaaaatcatcgttaatcctgaatcaagctaagtcgtttaaaaagtcagtcgaagccacgttgggtaaacaaaacgtcatcattgatttacaactgttgagcgatgataagtataatgtcgcgactttcaacgcaacaacgggtaaaactagtgattttgatattagtaacagcactggttggtcgccagactatgacgatccgtcgacttacctcgaaatctataacccagtttcgggggcgaacttgcacaccctaggattagagccaaccgcaacggccggtggatcagcttccaatgcggccgcaatcaaagcagttggttttgatcaatacagtaagttattggccaaagctgaagccattaatactgataccgctgctcgctataaggcgttcgcaaaagcggaagcatggttgttgaatagtggaatcgtgattccgactaattcgggtggtgctgctgcgattgtcagccgaatcgaaccgctcagtggtccgtatgcgccatcgggaattggttctggtcgctataagttttgaaagttcgggagagtgccgtcacgacgtctgaagccaagaaggcgcgggcggaatggctcgcaaagcggaaacaaattgcggaagatacgccgacaaattaggtcgacccttgcgtgaaggaaagagggctagcaagactagcctttttttctgtatctgttattacgaacgtgttgagttatgaaggaagtggtgggtcgtgaagaaatacttgttttaccggatgttgcgatcgttgctgagtatcttcttggtcacaacgctcacttatatcatcatctattcgttagttccgcgacgtgatatttttaaatccgatccgatgatcagtaagctgagtaccagtcctgatcagttagtcgattacgagaataccgcttatggcaagatgaattatatcgactatctggatactaagtcactcctagcacaggcgtcaaatcgggggcaaaccggtgtgacggctgcgcacactgcggtcaatattaaccgattgcagcagtgggcaacacggtaccactatgtacttcatcgctatccgaaaagtgggaattattatgcgacccgtgagttacccttgtggcaacggttggtgaagttctattcgggactgatccaggtcgatacgccatgggccattcatgatccggataatcctaagttaccacggtatttaaaaatcagccacgatccgattgtcggctggagcttgattgggtctggcacgcgctacaagtatcaattatatgtcaattcgatgtttccatacttacatgaaaacatcgtccatttgaacctaggaatttcctatccaacctatgctggcacacgggtcactgaggtgattggtagtcatcaggggaggcggtgacgcaccagtatacgtttgcaaatggtcaaaaatgttgagcactgatgatgtctatacgcgtcagtatcagccgaccagtcggcaaaagatgcgacggcccgagcacaatatggtgacaattacactgcggtggtccaggagaatcatgatccgtcgatgattgggacttcctttaaagctggatttggagcactaatcattgcctatgtgattgcgattcccatggcaattttgatggcccgctataaaggcaagtggttcgacaaactcggtacggggattgtgactgccctaattgcggttccaagcttagcctttatctatgcgtttcggtacttcggcaatgccgtctttaacttgccggatacctttccaacaagtggtgcgagcgtactggcatcgtgggtgtcaccaactttgattctggggttactatcggtttcaggcttagtcatttggtttcgtcgttacatgattgaccaacagtcagcagactacgttaagtttgccaaggtcaaagggctgactgataacgagatttatcggaagcacatcttcaagaatgcttcattaccgatcgtacaaaggattattaccagggtcaatcatcggtttgattggcggtgcgacaatgaccgaaacgatttttgcaatgcctggcatgggtaagatgttgccggatgcgattttaacgcataataacccgattgtgattggactagtctttatctttacgacgattgcggtcttttcaatcttgctgggcgatatcttgatgacgattgtggatccacgcattaaattgacagcaacgggggatgattaggatggtaataggtcgagataaaccgcaatctgaaaaagtcgaccagaaccaaatcagtgacgcggactttgaatttgtaacgttgaatgatcaggccaccgaaaagatcgaaacgccgcgatattcttattggcgctccgttgcgaaagcctttttgccaataaactgacgattgcgatgttcgtgctgatgctgataattctattattggcgttcatccagcccttgttcagtggctatagtctgatgaacgttagtaacatcaatgattttggcgcacgctacaattggccgagctggcactactggttcggaacggatgctgatgggaagtctttatttgatgccgtctgggcgggagcccgcacatcgatttcgattggtgtgattgcgtcgttgattacgacggtgattggcgttgctgtaggcgccttttggggcaactccaagaagttagaccgggtgatgctggagatttataacgtcttgtccaatgtgcctaatttactgattattattgttttatcgtatacgtttggcaatggcttctggaatctgatttttgcgatgacggtgacgacttggctggatacggcgtattttattagggtgcaagtcatccttcgacgcgatcgtgagtataatatcgcctccaagacgctggggacgccgatgggacggttgatcattcgtaatgttttaccgtatctgacgtcagtgatcgtgacccaattgtcccaattattaccttcgttcatttctttcatttgaagtctttctgtcatttttaggagtgggactgagtgccaacgtaccgtcactcgggcggctaattgcccaatattcgccagatatgaccagctacccgtacttgttctggttgccggtaaccgtactggcgctgattaccgtgtcgttgtacattgttgggcaaaacttggcggatgcatctgacccgcggacgcatcggtagccacgtgttgataagtcaagaaagtaggaggatggtgtgatgaaaagaccagttgtattagctgttgatgatctttcggtgggctttcaagttcgcggacagcaattaaaagcgattcgccacgtttccatggcattatatgatcaggaaatcctcgcattggttggcgaatcaggatctggtaaatccgtgttgacgaagacctttacgggaatgttggaagataatgggcacatcaccggtggacgtattcagtacggtgacacctgtttgagtgacttgaagacggactcgggagtggaatcagattcgtggcaaggggattacgaccatctttcaagatccgatgacctcactggatcctatcaaaacaattggttcccagattgcggaagtgattatcaaacatcaaaagaagtcggctgcggaagctaaagcgcgaggcaatcgagttgatgacccggacgggaattcccgatgctgcagagcggtataacgaatatccatttgagtactctggtggaatgcggcaacgaatcgttattgcggtcgctttagcttgccacccacaaatcctgatttgtgacgaaccgacgactgcgctagacgtaacgattcaagctcagattttggatttgatcaaacaattacaacgtgaatatcatttttcaattatttttattacacatgacctaggtgtcgtagctgcaattgccgatcgtatcgcggtaatgtatgccggccaaatcgtagagctgggaacctgtgatgaaatattttatgacccgcgggcatccctatacttggagcctgttatcggcgttaccgcaactggccaccgctgattccggcttatattcaattcccgggacgcccccgtcgctatttcacgatattaaaggtgaggcctttgcgccgcgcaatcggtatgcgttagcggccgactttaagcaggaaccacccaaattcgaggtgagtccgacccactgggcgaagacgtggttgcttgaccccgggcacccaaagttgagaaaccggccctgattcagaatctacacgcgcgcctaattgccttgaccaagtcagaaatgcagattggtcagatacggggagggacgaccaatgactaatgaaagaaagccactcttagccgtcaagcatttggagattgcctttggccaaggaaagcgggaattcgtggcggtcaaggacgctaattttgacctttatcgggggagaccttggcgttggtcggtgaatcaggatccggaaaaacgacgattggccgcgcaattacctaggcgttattccgaccaagaaagggacaattgcgtttcatgaacaactcattaatcagcacttagcggtcgctgcgcaacgggaagtgatgcgcaagattcaaatgatttttcaagacccagccgcgtcactcaatgaacgggcgacgattgaatatattatttcggaagggttgctgaattttcacctctttgattctgaacaggatcgccgtgatcaagttgagcagatgattaaagcggtggggttgctaccggaacatctttatcggtagcaaccatgaattctctggtggtcaacggcaacggattgggattgcccgcgcccttattatgcggccagagttagtcgtggccgatgaaccgatctcggcgctggatgtctcgattcgagcacagattctgaatctgctccggcagtttcaacaggagagccaattatcatacttgttcattgcccatgatctatccgtcgtgcgctttattgcagaccgtgtggccgtcattcacaacggtcgtattctggagcttgcaccgaccgcggccttgtttacccatccactacacccgtatacgcaatcgttattagccgccattccaatacctgatccacagttggcgcgacaaaagcaactcgtgacttatcacgaggcagttcacgattatgtgactgatccggctcaattcgttgaactagttccggggcattttatctatgccaatcgatcggagctggtcgcctatcgtcaacaactgtctgtgacgtaaggtcgacgctggccacaggtacgtcgacctaaaatcgatcaagtgaacgtaaagaaggacacaaaccagtttggtttgtgtccttctttattagtccccgttgtaaatcgaatttttaacgaccacatagtcgcacttagtaatggcctttaaatcccggccaccggcatatgagatggatgattgtaagtcttcttgcatctcgtttaaggtgtcaactaagcggccgcccggtaaggaaccagcatttgtttaccctcaacgtttttatgttcgcctttttgagtttcactggcggaaccgtagtattgcttataagtcttaccatcgatttttaaaatgttgccgggtgattcttggtgtccggccaacattgagccaatcatgaccatcgtagcgccgaaccgaatcgacttggcgatgtcaccattggtccggacaccaccgtctgcgatgattggtttgcgagcggccttagcacaccatcggacagcagctaattgccagccgccagtaccaaagcccgttttgactttagtaatgcaggccttacccgggccaacgccaaccttagttgcattggcaccagcattttcaaggtcgcgaacggcggctggtgtggccacatttccggcaattacaaaactatccggaaggacgtctttgatgtgcttgatcatcgcaatgacactgtcagcatgaccatgtgcgatatcaatcgtgatatagttctggcacgatttgattagtagccaggtcgtcgataaagtcatactcgctggacttaacaccgaccgaaatagatgcgtacagttgcgcggcatgcatcgtttcaataaaagcacggcgggtctcggggcgaagcggtgcataatgtagaagtagtcgttagtggcgagccacttggcaatctcgtcgttgatgacggttgccatattggcgagcaccactggaatcttaaaacgacggccacccaattctacggtcgtatcggcttccgaacgactattaatgacacacttgttcggaattagttgaatatcttcgtaatcaaaaatctccatgcccatgatgcaaaactcctttaagttaattcacggtgtcacgttcaattagccccaaatgttgtgatcgataacgttagtttgttcgcgatcgggaccaacagagaaggtggcaattttaacgccgacgagttcttctaatttacgcaagtagttctgtgcatttagttggcagttcctcaaaggttttaacgccagtaatgtcttcgtcccagccaggaagttcttcatagataggtttgcaagcttctaattccttcagactagcggggtagtgatagatggtttcgccgtttaagtcataagcggtacataccttgatggtctttaagcccgtcaagacgtctaagcagttcaaactaagatgagtaaacccagaaactcgtttagcatgccgtaatacaacgctatcgaaccaaccaatccgccgaggacgtttagtaacggtcccatattcatgggccgtttcacgaatgaaatcaccgacttcgtcaaagagttcagttgggaatgggccgtcaccgacgcgggaagtgtaggcttttaagaccccaacacagttatcgattttagatgggccaacaccgctcccaatagtaacaccaccggcaactgggttagatgaagtaacgtaagggtaagtcccttgatcaatatccagcatgagctccctgagcaccttcaaataggacgcgttggccgttatctaacgcatcattaatgacaacggaagtatcggtgacgaatggtttcaaagtttgaccataagcgtaatagtcatcaaaaatatcttcaaatttcagtggttctaagtcataaagcttggtaataatttggttcttttcagctaagttgcgcttgagtaacgccgcaaaggtgtccttatcaagcgggtcggctacgcgaatcccaattcgttcagccttatccatgtaggctgggccgattcccttattagtcgtcccaatcttgccaccggctttagctttttcttgagcgccatctaatgtgatgtggtaaggcaagatgacgtgtgcacggttagagattctaaggttgtcaggattaacgcccttgtcccgcaagtattgtaattcttcaactaatgacttgggatttaagaccacgccgttcccaatgacagctaacttatcatggaagaaaatctcctgatggaatcagccgtaatttgaaagtttgcccattaaatacgatggtgtggccggcgttatcgccgccttggtaacgtgataccacatctgcttcctgactcaaaaagtccgtgatctttcctttaccttcatcgccccactggctacctactactacgactgatgccatattcttccacctcattaaatagtttaattatgaataattaatcctaaagagtagttaaacgttcaccactccaacaggaaagagtatagcaactttaacgtcaaaacgcaacccaaaaaccgaatgttcttgttttgagcacaaataatcgttcataattaaggcgaattagttcgaaaacaagtccttaatatggaaacgaagtgaaaaataacagtgtttttcattgttcgtctctattaattactcgaggggtatgctataataatgttcgtgttttgttagtgaatacctaaaaagaaatgaggattagcaatgattgatcgttatacgcgtcccgcgatgggcaaagtatggtcgttagaaaatcagtaccaagcatggttggaggtagagattgctgccgacgaggcctgggctgaattagggaagattccagcaagtgatgttgctaaaattcgagagaatgccaagtttgatgttgaccggatcgcggagattgaagccgtaacgcatcatgatgtggttgcttttacgcgcgatgtttccgagtcgttgggtgcagaacgtaagtgggttcactatgggctgaccagtactgacgttgtcgacacggcgcaaggttaccggttgaagcaggctaacgcgattattcgccaagacttacaagatttacgggcgacactagcacaacaagcgaaaaatataaatatacggttgaaatggggcggacacacggcgtccacgctgaaccaaccacgtttggattgaaaattgcccggtggtattctgaaattaatcgggatatcgagcgttttgaacacgcgaagggccgcgggcgttgaagcgggtaaaatcagtggagccgttgggacttttgcgaacattccaccatttgttgaagaatttgtctgcaaacaacttggattgcgcgcacaagaaatttcgacgcaagttttaccacgggacttacatgccgaatacattgctagtttggccttgattgcaacaagcgttgaagtgtttgcaaccgaaattcgtggtttgcaaaaatctgaaactcatgaagttgaagaattctttaataaaggtcagaaaggctcatcagcaatgcctcacaagcgtaatcccatcggttctgagaacgtgacggggttggcacgggttattcgcggccacatgatgaccgcctatgaagatgtgccattgtggcatgaacgggatattacccactcttctgcggagcggatcatcttaccagataccacgattttagtggattatatcttaactcgaatcaataagattattaagacgctgacggtgttccccagaacggatgaagcaaaacatggatgcgacttacgggttgatctacagtcaacgtgtcttgctcaagttgattgatacggggatgtctcgtgaaagtgcttatgacctcgttcaaccactgacggctaagtcatgggatgaacagttacaattcaagccacttgttgaaggtaacgccgagattcgtgaacatttggaccaggctgcgattgatgatgcgtttgactatcattaccatcttcgccacgttgatgatattttcaaacgattgggattagacgattaatttaaaaacgatgaagccccagcgatggtaatcgctgaggcttttattatgattaaaacgtgttaaaaagatgggctgtttattcgtcagccgatgcgcgtcctatttcgacctccggggctggggacgattactggctatttttgagcttgataatggcacggtttaatcatgcttcatactaaacgataactagcgcaatgcgtgtaagtaccaccttgatttcagttcaaggaaccaaatgttaggtgcgtcgcaatcagaccatacccaagtgccatatgacgctgttctttgcgcgtgaggcgctgtaattgggtgtgaacgtattggtagaggtcacgatgctggcgtggtagagtcattgggcccatatagttacgataataggcttgatatagctggatggttacttgctgtggcgaaacgttgttattcaggtcgattgcagctgccagtagcgcttggcggtaggaatcggatggttgattggtaatcggctgattataagcagcatctactaaggtaaataattttggagcatccgcatccattgttaggaccaacctttcaatcgttgagataggcgcaattatagcatggtcagtatgcttgatgtgcgaggcccgagttggtttctaaagtaatggaacgaacataaccagagccgccaatgagcgggggtcattggcggctctggttattaataagggtattaatcaagcggcggtcgcagcagtgttttctgttttaagcccggtgccaagctacgtagccgatggttgggaaaataccgatcaaacggtcgatttgttcacggtctaattgatattcgatagctggcagtagtgcgttgacggcatcttcagcttgatcactgatttcagtcacgccaacgagatggccgtcttggtcatggacctgtttactagcggcaatcggttccttggagacttgataataccagtaatctgctaaatcattatcactaacggttaagccggctttttcagcggccggtattttcatgccagcttgcgcaattcgtggtgaagtaaagacgaccgatggaattaccggatagtcaatgggagcactggtttgaccagagaacaaacgcatcaagtatttggactcaaagtaggctgcgggtgtgacctttggcaagtcattggcaaggacatcaccggctgcatagatgttaggaacgttgggtttgcaagtggtcgttgacataaacgccgtggtggtcatatttgacgccaatccggtctaagcctaagccatctaagtttggaattcgaccagtcgcatctaggatccagtcggtcgttaattgctggtggtcgccataactaacttggaactggtcatcctgtttggtaaatgcttgcacgttggcatttttgatgaaggttaccccacgttcggttaagtcgtcaaccacttgtgcaacgaatggttggtaaaaatcacggagggcctggtcgccatgtaacatgactgtcacttgggcaccggccgcgttagcgatggtggcaaattccataccaatatagctgcgccaatgatgacgatactttgtggtaaccgtttaaggttcataaaatcactactatcgtgggcgagcttggtccccggaatatctaaacgatggggctttaaaccagtcgcaataacgattttttcagcggtaatgttttgctgatcatcaaacgacaacggtgtgagcgtccttgaacgtggcatgaccatgaatgatcgttgcgccaccatcttccaaacgagctgtcaggcacgctggtaagggatcaataatctcttgtttatgggccacgttggccgtccaattaatggttggtgcactgctcaaaatatcatttaggcgtgctgcttcccgcgttaatttgacaggttcatcaagagtgattttggcgttacaaccacgattaggcgggtgcccccaatcagaccactctcaatcacaccgacgcgaacaccagtcttggcgagtggtgcggcgccatcaaacgtggcgtgacccgcaccaatgtataacacatcgtaatcgtatttgtttgtcatgatttatcagcctccattaaaattttggtaacttaagcttaacgagttttaagaaacctgacaactgatatgaattgctcgcgcccgctgtaatgattatactaaaagtaattatgtcaatagggagacgttaatatgcacgctttgatcgcaattgattcatttaaaaattccatcacgagcattcaggccaaccgaatagtggctaaacgatttgcggctcacggaatcaccgctactcaagttgcgattgccgatggtggtgaaggaacggtggcggcgtggctggctaaccatgctggtggacaagctattacggcatcaacggtggatctggcgcaacggtcagtgactgcaacgtatggctactttgccactgaaaaatggcagtgattgaggttgcggctgcatccggaatccagtttgtcacgacgaccttgacgccgttagcaacgaatacctatgggaccgggctactgattaaagatgcgattgagcgtggcgcccgtcagattattctgggcttaggtggtagcggaacggtcgacggtggtgccggaatcctacgtgcgctcggttatcgtttttgggctgccgatggtcaagagttatccatgactggcgctgaatttaagtcgggtcactaagattgacgatcgacatgtgttgccacaattagctgaagtctcgttcattagtgcagcggacgtgacgaatccgctaacgggaccgaacggcgcagctaagatttttggcccacaaaaaggattaccggttgctcaaattcaggttcacgatgccgctttagctcactatatgacggtcgcagctggtgcggtgagtgcccacgaaggcgatggggctgccggtggtattgggtttgcattacgttactttttacacgcccgcgtttgctctggttttcaattgttagctgaaatgagcaatcttaaaacgaaagtggcccaagcgaatctagttatctctggtgaaggccaagtcgacgatcagagttttatgggcaaggtaccaattcagctcagtcagttagcccaagcggccggcaagccttgctatttattagttggtcggcagaaaggtgcaaatgaaacatttgccaaacaggggggtcacggccgttttaccgattgtcgatcaagtcatgaccttagatcaagccatggcgcgaggaccagccaatctggaacggatggcggaccgcttagcccgaatcattagccagtcataaaaacttaagcggtcaaaaaaaacgtatgcgtagtgaatagcgcatacggtttttcgactgaattttatttatcaggaacatagtgatttaaaaaggctgtaacatgtcgttgatactcggcgggatcgatccaaaaactctcggcgtgagtggcgttgggaacccgccacatctgcttggggcccttagcggcctgataattttctttgagcatccaacttgggacgtagacatccttgtcaccgtgaataaagaagatcggtagatggttatgtttgagctgttcgacagaactgacgtcgcttaaataatagcccatacggtggcggttaataaaactaacgatgggcacaaacggatactttggtaagtgaaactgaggtcgctttaataagtaagcgagttcttcctcgatactcgaataaccacaatcggcaatgatggccttaacttgtgatggaaggtcttcgccgctcatcatttcaacggtcgcaccacccatgctgacaccaaaaggatgatatccgtgtgacgaccattgatacggacgactttatcgatccagcctaaatagtcgcggcgatcccgccacccaaagctaatgtacttgccggcactttgcccatggccgcgatcgtcgggcaagaggacgttatagcccatttgatggaacatataagcgtaatttgccatcgtttcaccatcacctttgtagccatgggaaacaataacggttcggttgctggttgttttagcaggaacgtactgtgcgacaaggtgattggcctcgtcattagcgttcagttgccactgctgaacgggctgtcggtgtagccaatcgacataagcgtagtaggcatcggcgtatttttgtttatctgcgccgaagtttcgggcacgtaatcaacacgcttgaaagcaaaatcgtagagcttctcactcgcgaatagggcggccgaaaaaattgccacaggagcactaattccggctacggcgcgtttttttcattaaatatcactcctctaatctctcaataatatgatacgccgattagaagtgagatgtaactatattattctagtaatataaaaggccatcgcggcgggcgatgacctataaattgcattggtcgctaggtggcatccccagcgagcctgtttttcattaactttggaggagtaaatgaaaaaggttcaagtggctgaaggagatgtccagtcactatatgtttagtatagtagtttgattgttaaaaggtaactaaatcgcttacttgactggtgaaaaactaaaaattatttgtgggtggtcaatattccggtatggacagatttcgtcgtgccaagtatgataccgattcaagtcgcattaagcctcctttgaaagggctagttcatgcactttagtgctaacttgattaaggaccgcgttttacgttcatctgtcaaaaagacgcgctgacttaaaattgggtagtgttgttcacgtgcgattagcaataattcacgataaagcaaagtggcggctaatagcgatggccgggcgacgggatcaatttgtggcatcatggttaatgcagcctcgtacttgttcatggcaatctgtgcttcatgttcccaaagccgaataaaattggcagatgggatggggccatgcaagtcagttggattgagctgatagtgtgccaatagttttgatggcggtagattcggccacgttggtagtcttcaccaacatctcttaaaatattggtgagttgcatggcgctgcctaattctacggctggtttgacaagtgattgcgggttagttgctagcattggcaaaatcatcagaccaaccgatccggcgacgtaatagcaatagtcttcaagtgcttgctgctggagagtttgaggttgtttaaaagtcgcgtcttgttcttgaccagtgagcatatcgaaaaagacgtcaagattcatatcataagtctcaaaaacgacggccagtgcgcgccacattgggtggtctgggacatgaccattggcaaaggtggtcaatgattggcgcaatgccattagaccatcaatatcatggtcaacatcaacgaggtcgtcggctgttcgacaaaaagcataaacggcgtaaatactccaagcgcgttctagtggtaattgcgagaaggcggtgtagaatgcgctagaagaccttttagtaattgtttgacagtacgcaaagtcagtgcgatgttgttcgaatttaggcattagtttggtcatctttaatcaactcctcaacggctaatttagcactttgcataacaatgggaacaccggccccagggtgggtgctactaccacaaaaataaagatggtcggcatagtcgaacttgttatggggacgataatcaaattactttgttttaacgtcggtcgtaagccgaaagtggctccgttataggcgccaaactgttctttgaagtcaaccggtgtaaactgcttttcgacaacgatatgctgttcaatatcgctgaaggtagccgtttgtcttagtttgttaatgattagttgacgatagttcttcagtgttgttggtgaccagtcattaaactttgagagctcaggaactggtactaaaacatagagtgcctcactgttttcgggagctaaacttggatccatctttgatggaacatagacataatacgagggatcttctggtaacttgccgttgtcaaatagatcggcgacgtttttgctgaaatcttgtgcaaagtggatcgtgtgtaatgcttcggttgggtatttttgtctagtcctaaatacaagacgagacatgagcatgaataatccattttggcaattttttgatctgtgtactgaccacgattttgctcatttggaatcagtgtcgtcatggcggttggaaaatcagcattacataggacatagtcactgtggatcggatgattattgacacgaatgccaacagcaactttatctttgatgataatttcttgaactggtgtggcaagctttaacgtaccaccctgttctttgaataacttaacgagactattgacaactgtgtacataccaccctttaaaaaatagaccccgtagaagagctcaatcatcggaataatgttgtatagcgacgggccctggtagggagaaatcccaatatacagtgtctgaaaggctaatgaattacgtagattttcattcttgataaattttgcaatgtttttgtaggcattgttaaaggtgcgtaactgtagtcccgcatacagagcgggtaggttataaaagtcacgccagttacgaaatgatcgttctaaaaattaggcttcgcgatggtataccggtgataaatatccgctaaaaatttaacataccattgacgtcatcaggcgcaatgcggttaatctcggcaattaatgttgggagatcgcgtgacaaatctagactagattgatcaccaaagacaaggtgcatcaaaggttgaacttcttcgaatggtaaatagttgtgcggatcgaccccgcaaaagcgaaagacttcttcgtagatgtctttcatcatgacgatcgtcggccccacgtcaaatgtaaatccttggctaacaatctggttcattttgccacccggttgcgcgttttgctcataaatcgtaacattataacctaatttttgaagccgtactgcagcggttaagccaccaataccagcgccaataatcgatacttgcttcatcagtaaatctccccttaacagatgaataactaaaaagcatggttaatcattagttatattttggtttaataatgtaaaaagtacaacaaatatgattactatgacgtattaaagtagtcggtaggtgcgaatagagcggacgagaaaaaacaaaaaaaaaccaccgtatcggggaatacggtggaaaaaggagtagggtaaacatgtgacggggaatcacatgttactatgaatttcattactttggaggagtaaatgaaaaattttaggttgtgttatagctgattgagttaacctcaattgctatgatgtaatcataccgaggttgtgtgaagaatttgtgactgaacatggcgaatgtcatgaaaaaaagggaaaggctttattaagaagtgtgaagaatcatcaacgttcttacggaatgccttggcgaggtgcgatgatcgactgtttggggccaaagaaaatagtcacttcaaaagttgtcctttgaagtgactattttgattcgcaatcaatgctagtaataacaagtttgcggcgacgctaagttgatagtgaccaagcagattttggtgactggctgtgggcactgccatttggcgcgattagttatcgtcacgattaccaccgaatagaataattagtcgtagtaattgtaagaatgttgacagggctgcagcaacataggttaaagccgccgcgacaagcactttacgcaccatgggaacttcgtcgcgagtcaaaacttgcccatcagataaaatctggagggcgcgtcttgaggcgttgaattcaactggaagcgtgacaagttggaacaataacgccagtgagaagagtaaaatcccaatgtgaatcagtgtttggttgtaactcaataaaacgccgataatgattagtggtaatgataagcttgaaccgatgttcgtgatgggcacgagggcggtccgcaagcgcattggccaatagttaacgtgatcttgaactgcgtgtccgcattcgtgggccgcaactccgatggcggccacagaggttgaatctgctgtggcttctgataggctgagaatcttagtttgaccgttgtaattgtcggtcagatccccgcttatcttttggacaccaacatcattgataccagattggcttaaaataaagcgagctgcatcggtgccggttgtgccagattgactacgataggcatcataatgccggaatgtccgattaacgtaacccgatgcggccattgagataatcagtccaatgatgactaataggtaagtcggatcaaaaaacgaatagaacaaggtcgacccctcctaagtggtttaatgttaatccgattctatcagatttagcgtgacattcctactgaagaaagccattggaaagtgtctttactatcgagaaacgacgtcagattatataattagcccagttaatcgtaattggcaaagagcgaaggagttttctgatggaaaagacgtatcgaaccaaaacgtatggggaaatgccgttaaagttagatactgggaaaggctggatttttcctaaaggtgttgaagtgaaggcgcatgttgatttagaaacgggacaggtcagtttttttattgcaccagaagatctcgataagatgaaataaagtattaggaccacgatacgcggtaaggttgagaagtttgtttctcgccttggcgcgttttttatggtggaaattggattggcaatgattatggttaatacggtgttcacgcgtgagccacaactacttgaaggcattaaaaacctccgtatcggggaaatacggaggaaaagggaagtaaatcggtaaaatgtaattaagtacacacacatcattacttgggaagtaatcattaaagttaggggtcgttaaggattgggatttccttaatgactataaacatagtatagcggcgacgcgtgaagaaagtgtgacgcgaaaagtttaaaagcatgattttcagacgaaaaagttaggtcatggaacgaaaaaatatgacgatttttacaaagtttataacgaaatgatgaccgtcataaatcaatatgagtggctaaatgctggtgtgacgcagtttttattggtcctagactctgaggtgctataatgaagcacaaatttaatcgaaaggtgttttccaaatatgacaattaaaatcgtcaccgattcgtcggtccaattaacgacggccgagattgcacagtataatattaaagtggttccgttactcgtggggttcggtggcgacttgattgcagatacggcagttagtaccgcggaatttgaccaacagatggcagtcagcccagtcttgccaacgactagccagccgccaattggtgatttcgtcagttgctacgatgaattgacagcggatggtagccaagtattatcactacatttgacggagacattgagtgggacggtcaatgctgctcgccaagctgccaaacttgctagtggcgatgtgacagttattgatacccaggcggctgaccgtgggatggcctttcaagtgcttacagcagcacggatggctcacgccggtgcggatatggccacaattttggcgaagataaccgtcattcggcagcatactaagacctacttgttcgtggattacgctcgacaatttggtcaaaggtgggcgcgtccctaagttggctggcatggtcacgaatttgattaaattaaaatttgtctttgaattagaagccggaaaattaaaactttatacgcgggggcgcgggaaaaaggcgctaatcaaagcgcggaacaaattctagaccaattagcggatgcgactcgagtcgaagcggctggaatttcttacgtcggcgaaccgagcgttgcggaagcgccagaaaagcttctccaacaagtcgttccacaagtaacgccactggttgcgcgtactagtccaattattgcgacgcacaccggtgttggcgcttacgcattgatgttttatacagttgattaaatttgacgaactaacctactattaaaaattactttgatgtgttataattaattaatgataaatgagaaccgtgttggtgcactgttctgagcctaaccaccatttaatgatgactagacccggatggggcacctttttgtcactcttttcactaaaagaaagtaggaacttatgtgagctatcttctcaataatccgtttttcgggatcggactgtcgatcttggtgtatgggattggcgagtatttatatcacaaaacaaatcgctttgtgttattccaaccgttatttttggaatgctgctcgggattggtttattggtattgattgcgtcgattctaaaggcacccgtgcaaaaagtttatgaagcgtaccaggttggtggcgactggttattctggtttgtggcgcccgccaccgtctcgtttgcggtgccactatataagcgtaatgatatctttaagaaacattgggatgtcattgtgattgcgttagcgattgggttagggctgtcattatttggtatctatgggatttcacggttgctcggtctgacggatgcagcgttaggtgccatgttagtacaagcagcaacgacagcaattgctttaccggtggctgagtcggtgggtggcgatcaagccattgcggcgttcgcagtcattctgaattcagttttgatttacgcgttaggcgaccattttattcgctggttcaaattgcacaagaatccgctcggtgccgggttaggattcggaattgccggtaatgcggttggtgccactaaagcgattgaagtgagcgaggctgcgggcgcaactggtgcaatcgcctttgtgattgccggtattcttgttaattttatggttccagggtttgcgcagttgattggtttaggttagatggtccgggagggattcgatgaaaaaaggcgcgtttattacacaaattgtgatttatggtttgattttattggctagtagtttaattgctaatttagtcaataagatttggcccgcattcccaatgccgacaccgttgattgggatgattctactatacttgctgttaacgtttaaagtggtcaaacttgagcggtggcgggtgttagcaactttttcgtccaatttactcagcttgattttcattccatcagggatcgcgttagtaactaagttagacgtgttaaaggcagaaggcgttcagattgtgatcgtcattattgtttcgacactaatgttgttgctttttacagcgggaatcgcgtgggttttaattcaagtcaaggaatggttcattgctcgtcgaacgaacagcaatgttgagttggaagaagattaaatcttggtggcacataatttactcgtgagtagattgggtaccagttggatctaatcgaaacaggcagttgttgaaccgcttgttttggctattacaagataatagcaggccgttgtggggattgcatacccatgacggcttttttagacggcaataaaaaagccaccacatcagcggatgtagtggtcaaggagtaggaaacatcaaagtgggggctttgatgaaccccattcatcagacttggggagtctatgaatgaaagtgattattagctgcattatggcagcaacgcactaataatcgaaaaactaaagaatattaaggattgacagtcagttggtcactttctatcaatctgcgactattataattgcaaaagttattggctgcaactaattgagctgattaattagtttaaagtaacgcggggctggaaatcagccgcaaataagcccatgtgatagaggtcgattcgttgcccatcacgcttgatagcacgcttattggtgccctcaaattcaaaaccactattctggtaaacagcgatagcggcggggtttgttgcgatgacgtccaaacagactttgtaaagattcaattcgttaaaagcgtagttcaaaatcaagctgagtgtctcggtaccataaccatggccgcgttcgtcgggatcaccgattgcgatggctaattgggcaacctggttatgccattcgatattgaatagggtgacaaagcctaataagtggtcgtcttctaaactatgaacgtgaaagtagtattcggtattctccgatcaaggttacggtaagttcgttcgagttcttcaccggtcagtggtcgggcggcagccgtatccattttacgaacaaaatcggcgtcagtgtaccagtcactgatctcatcaaaatcttctggctggggaacagcaagggccacatggggcccgacaaacatatttttcaaaataatccctcactcgtatgatgttattaaagcttatcttcatggtggcggcaaaaggtgggcttgtcaaccaaaaattatgagattacgcgtcagactagctagctcagtatgaaacacgggtggcatgtgccaagtgctgatgtcaagaacaactagctctggggacggcgaaataagatgcggatatactgaagacttacagtaaagccgttgggcacgtgctgccgataatgtggtttcagtataatgagggcaatacgggtgatggctgaactattggtgaaaggtgttgctgtgggggcacttttcaatggtgcgtaaaagagaggttagcacaaactttacagttactttatatgaagattggtaaaactttacgttagctcgctatattagagataaccatctggtgattaaagtatgagagggaggatcgaattgcgtcctttacaagttattcagatttctgatctacatttaacccccgcggccaagtaccggcacatggtcagcagtacgatccctggggcaagcttgccaatattattgatgatattcggcgattaccaaccatgccagatttgattgtttttaccggggacttgattcatgacggtagcgctgacgattatcagcggctgcacgcaatcatccatacgatggaagctgaatttgattgtcatgttcgagttatccttggaaaccatgatcggcgagcggcgttttacgaagggtatttgccggctgacccgggaccatactacgcgagtcgcatgcggattggcaacaacgacttttatttttggattcaaaggttagcggttatgaggcgggctggttggcaccacaacagctacaatggttgggaaaacatctacgacaggcaccgacaaagcgggcttttctatttttgcatcacccctagatgggccgacgatgacaaatatgcactatgcgattttacaaaatacgccggcgctgttatcggtgcttcggggacataatttaggcggcgtattctctggtcacgttcactttgtttcaagttatttgattggagataatattctgaatgtggtggccggttctgcggcctatgcgatcgattgccatgatccacatcatcattatgttcatgagggcagtagttaccaaatcattacaatcgatcgaggacaggtcggtgtgacaacgcgccagttactgcatgggaaagcggttattgatgaattgacgatcccagacactaagtttgtcgggcgagccccacaagggtatgaatcaagatagcgctttcttaattaacaaggtataatgttggtaataattaagggaggcgtcaatatgggactatttcgtcatcacaatcaaatgccaccacggatcaaacgtaaattaaagcaacggttgttacccgttgccgccatggagattaccgcaaccacaattgtggttgcggatgtcttgacggcgaagtcatttcgccgaggacatcgacttggctggttgttattagcctttgtacaaccatttggaccgtggctctattttgcgtttggacaggaacgttagggtaattagtaaattaaagtggggttaagttcgggtgaaagctcggactttttacgttgatgggcgtttttgcacgtttatgaatgtttttttgaatgcaatcataagcgtgtataataaaagtgtatataaagatacctataatttgaaattattatggtaatccgaatcatatagggggactttattaatgcagcgagaatcagaattacgacaacaatctcaagaggctattaagggactaattccgtccggttaagtgggtggtctgatcagtcggggacttattggatattattgatgtattaatgcgggtcgaaaaaaattactacgactaagaacccagaagccttagtcaatcgcctagtaaactatattcgtagtgtagccattaagggacggttacactttccagatgaagaagaaaagctaatgatcgacttaggaataatcgggcaaaaggccggattgaacggggcctatatggctgatttctctgacaagtcacagttctatggcatgctggaagaagtcccacaacattaataccggccaggggttgagggctaccggtcgtgtaattgctgattggtattccgaaagcgtcctccgattgtgatgctgattaaagcgtaagtaaaatcagcttatcgtataaattaaaaggaacacttcaggctgtgatagtccgcttaaggttgacagggactaatacaggaaaactgaaagtgttcctttgttttagggataaccagcgcgctaaatagccggttgccattgaactggttctattcactgtgcgtcaatttcaatcgctttaaatcagctgttttagttacattgagtagtttctggcagtctgggcataatccatagacttccatattgtgacccgtaaccaagtacccagagagttccgccgccttggcttcgacactgcggaggtcgggttcgaaaacgtcagtaattttaccacaattctcacaaacgacgtgataatgtggtcgtccgaaaaagtcatagtgggtgccagcatcgccattttgtaattcaattacgattcctaagtcgacaaaaagttttaacgtattgtaaaccgttgccaagctcaggttaggtaattgagttgctaattcctgatagatggtttcgacggatggatgattatggtgagtaatcaaataattaagaatgatttgccgttgcggcgttacacggattttatggtcctttaattgctgcaagggcttgggtcaacatatcttctgccacgacgcggttcctccttttatcatattcacccttattaaaccacactttttagaaggattccaatttagaaacattactagatgaaacttttgacaaaattaattaacgaaatagctgaaaaggctttactggggctgaggccgtgagtaaactaacgataattaagtgaatgtggatagaggtggtaaaatgacgcaattaattgtaccagcattaccggttgagcgggtccaatacgaacgcgcatatgtacttggccttgaagcaatgatgaaagttatccggcaacttacgactacggaaaaaggacggcggtacccactaatcagttcccagtatttgcggcgagctatgatgttccccaagcgttggcacaagttgcagtcctaaaagccgctactactcggttgaaggttcgaccgattcagttgaccgtgacccggcagtgcgtgacgttacgattccaattacacaaagcatccgctggacaaccagtctgggtgccgtccgccggggcactatggcgcctatatgatggcttttaagtaatttagttgggagccctttccaacacctagcaaatattcagattggcttacagcgcgttattggaccactgacagtgactacgccaatacgccctagttttcaaaattatgatgttcgactgaccccaagtgggcaaactggttgcctagtgaaaattcacaaagcaccagcaatattggcacgacgggcaccgatataccagttaagtcattactcggaaacgattcggccggatgactagtcgtcattagctggatgattctaaataatccataatcacactgatagccagattaacggcggccataaaaatcccaagctcatttagcttgggatttttgtggccggtatttaaggcctatcaattgacttaattatgcttggtggcgcaacgtcacattatcagttgtggctacttgagcatctcggcttgtgcccacactagcagttgagcttgaatgttttccaggattttcatggataactggtagtcacgttcggacccggtgctattgaagctcaatgtacaggttccggcaaacgtgctggcggcaatttccataacgggtgagcactggaaggcacccgagaagacgcaattgacgaccgtcaagtcatgaaatttaagccgttcctggtcgacgacaccaaagttggtataccggagcgcaggctgtggtaaccagcgtttggtcattttacgcatgaccgtgattggcattgtatggttcattttctgtaaattgctaagtcgataaaggaaggcgacccgcgtacgctcgaccgttaacaagtcgtggacttgattgacgagctcactaaaaggtgcatcaatatctaccttgattgtcagaaaaacattgacggttaaattagcgatttgggtgacgttcgcatcttcagtcgtgaagcggcgcggtcgattgggagcacggcaatgtcacggttgtatgaccagttaaaacttggagtgctttagcgtatgccgccaaaatggcctcgctaataccgacgtcttgggccttagccattcgtcggacgcgcatgaattgcgtgctactgagcattacgtgaccaccgtgccgcaagttaattcccggataatggggtagtttaaccataccggtaacaatgggtgcatgaccgtgtggccgtgcaaattgacgttgcaacttagtgataactgggcgtagtcgccgttcattatgcaaattcgtgagatcggcataattgtaggcttgtgcgagcggtacagatattctttaaacccacgattgtccgttagtaggtggctcataaaggcttgtaagacatcgtagtcaccgtgatgaatgacaaataaccgtagttgcggactattcgtaaaatcaaaatcagtgttttcaggactatacgggctttgaacttcctgaataacttggttgacctggttgatcagtaacaacgaaacgattacggtcagcttgataatgaccgaaaatctcgggtacgatttgtgcggaagcgagcacggcagcctttaagcgttccacgtcgatctgactggaaaaaacgattcgcgaacgcattaatggcgcggcacctgtagtatgtagcatattcaaaaagtcaagtgcttcaccacgataatacacgattaacccccaatcaatttctctaatcaatagtataacagactctattcatcacactaacaatggacgtttggttttgaaaaagttaagaaacatttgtgaaagtttattaatcctgtgatggcgataaagcactgcctcgattattatgtctggtagttatttcgatgagcaagcaataatcaggcccgctaatgaatgtctcacctcgtttaaaattagacttaagataatggcagttacgcggatggggactggaattgctaaactgactgaatattcagcagttaaagattaaaattttgatgaaagcagctggtttttgtaaccggttccgactatttgccaaaaaggggtatactaaaagtaattacaacttaaaggagtttttcacaggatgaagattatcgcactcgtcggtagcattcgacgttcctcatataatcgtaagttagcaacgtttgttcagaaacggtatgccgatcaactggatgtcacgattcctaacttgggcgcgttgcctttttatgatcaggatatcgagctagaagcccccgcggaggtgcaagcctttaagcagacggtcatggacgcggatggcgtcatttttgtgacaccggaatataaccatagtgttccaggtgtcttggaaaatgcgattgattggctatcgcgtgttgaacgaccgttaattgggaaaccagctatgattttaggggccacaatgggacccttggggacagtgcgagcgcagagtcatttacggcaagttttagattcacccggagttgggatgcagattctgcctggaaatgaattcttgttgagcgcggtgcgggacaagatgaatgccgatggggaccttacggacaataaggtcgttgagtggttagaccattatgtggctgactaccttaagtttgctcaccagttagccgcaaacgactaattcggataaaataattgataaggggaagtttcaaatgaacaaagaacgtaagttgatttatgttattttgaatgacgaagatgtggaatatgatcttgaagaattaccagatcaatatgtggtctatattcgccaacaagctggggattcacgcgacttgtcgttagttaatactgagattcagaacctgtttaaggatgccgaattggactttgaagaaaagatcaagcctgaaaatcggaaggctgacattgtgctagctgttaagcgcagtacggtggtagatgactaataaacaagcgtaaacaatagttgtagcggattgatgttttgccgttacgacatatttttttgtaagatcaaattattggtctcaacattaatcaattcatgtgaggagggctaacaatgactattgagacactgtatcagcagatgttagctgccatggggccccggcactggctccaagccggaatcccaccgccgagacgccttgggagattctctggggcggtattctcgttcagaataccaactggcgcaacgtggattacgcactggctaatttaaaagcagccactgactttgagcctcggcagttactagcattgactgatactgaactgacgactttagtcaaactcgcgggcttctatacgcgcaaagttccaactttaaaagccttagcagcgtggtgtggacagtatgattttgacttgaccgtgatgcgagccttgccagcagaacaattgcggcgtgaactaatcgccccgcgcggtattggcgatgaaacggctgactactttagcatgtacgtttttcatcagccaacgatcattattgtgacacgtatttgcggcgcctattcggctggcttaaccaaccgttaccgagcaactacttaaaggcccaacaactgattatgcgcaggcgtggcattatgatttaacgacggcttgggagtggcacgcactgattgttgatttcggtaaacaggtcaaaacgacggctgatttcgaacggtcctttcttgcaacgcaaagattaacacttgcttcacaaagtttggcaaactaattaaataagttcctaaattcaagtgaaccgccttaatttaatcgggttttattgaccgacttaataggggcggctattattatgtttataaaagaaagcgcttttatggttaagggcgttacttgattagttaggagggcctgacagttggtcactggatggattggcaattattagtgattttataacaaccagtgtccgaaattagtttgttaacaacgcgattattgattagtcaaagggggagaatcgctatgaagcaagtgcaatttattaacgccagttgcgggacagttagtgccactcgaatcggttcacgatccggtgttttcacaagggatgatggggcaaggatttggtattgaaccgacagatggacaggtcgttgcaccaatcagtggtaaagtaacgatggttgcagcgagtctgcacgcgattggctttacggggaacaatggtctggaagtgttggttcatcttggtatcgatacggtcgaactagcagatcggccaccgtttaaagttaacgtgcaagttggtgatacggtcgaggccggcgaaaaagtggccgtgatggatttagcggcgattactagtgcgaacaaggataccacggtaatcatggccgtaacgaatacggcggatatggttaccaaactaacgcccgaactgggtgaagtccgtgccggggtcgtcggtgctgttgttgaattgaaagaacacgttgccgaagcatcggtggttaagggtaagggcggcaagtacgatgaattggcgactcaaatcattgctcaagttggtggaccggtaaatgtgaaaagcgtgattcactgcattacccgggttcgattttacttaaaggacgaagggcgggccaatgacgaggtaatccgaaacctaaagggcgttatcgatgttgcaaaggcggtggtcagtaccaggtggtgattgggccagcggtgaccgacgtgtatgatgcaatcgtgggtcaactaggcgcggctttggggatgctgacgcttcggctgttgcgatggagaaggaagcgaaccgggtagcgtggcagaaaatgacgccgtggcagaaggtcaaacacggttttagcagcttgattggtattattacgggatccatgattccagtgattgggttgttggcagcttctgggatcttaaaggggattttgtcgttactaaagaacttcaacctcgtctctgcgacaacgccgacctacgtgattattaatgcgatgggtgattccgtcttctacttcttaccgatatttgttggtttcaccgcagccaagaagttaggggctgatccggttatcatgggaattattggtggggtcttaacatacccagcaattgttagtatggcaacaaccggaaaggttacgggtcacttattgggaatggcaatcaatgcgaacttctttggcattccggttcacgttgcctcctatacctactcgattttcccgatgattgcgggggcgtggttagcaagtaagttggaaccatggctcaagcgggtcatcccaacagtcttacggatgatcttcgtaccgttgtttgaagttgtgattatttctggagccatcattatcatcctcgggccaatcattacagctttgtctggcgcattggctgcgggaattgtggcgatttacaaactcagtccagccatctctggcttaattatcggtggcttctaccaagtattagttatcttcgggttacactgggcgattattccaattgttgtcaacgatattacgacaactgggcacagttacttgaatgccattgtttctgcaacgatggttgcccaaggtggcgcggtcttagcaattgcgctgaagtctaagtttgctaatattaaagagctcgcttggccagcaacgatctcagccttctgtggggtcactgaacccgcaatgtacgggatcaatctgaaatacggccgggcatttattactgcaagtatcggtggtgctgtcggcggtttcttgaccggactgtttaacgttaacatgtggggcttcgccggatcattgatcggtgtgacctccttcatcaatcctaaggggcttgattttagtttctacggtttcttgattgcctctgctatcgacttgattgtcgcctttacgttaacgtggatgtttggcttttccgataatgatgtcaaaaacgttaagaaggcgcctgaaaagaagcaccttggtcaacaggttgcaaattagggcttaactatttttagaagaaagcatttcttagggctgctcttgtaatgagggtagccctttctgtgtatttaattttaacgatgtagcgacgaaatgtttccgaattaatggcggcaatgggtgacgttaatatcataagcggccgctttatttgacaaatatatcgatatttagttaaatgtaactaataaagttacatgaaagggcgagttaaattgaaatatgcgattacaggtgccactggtcatttaggacaacagattgttgccgcgatgagaccgttagtcgccaccactgaattatatttaggggtccatacactcagtaaggcccaggtataccaacaacaaggtttgcatgttgcggctattgattaccagcagccagagcagttacgcgcatttttccaagacagtgatgtcctgatctatattcctagtaagagtcatgatagttattcgcgggtccaagaatttgagaacgtcttagcagcagtccaacaggcgaatgtgcatcatttcctagtcatgggtttcattgccgatcaggtgaataatccatttgaattatcagcattttatggttacgtgccccggcgattagctggaagtgatattaactatacgattgtccggaatgcgctttacgcggatccgttagtgccatatttgccagaattaattgaacggcacaacgtcgtttatccaatggctgatcaggctctcagcttcatcagtcaggcagatagtgcggccgcttttgctaaagtcgccacaacgactgatttattacaacgtggtcgaatctatacgttaacacagtcccgagcttacacgatgccggaactcgctactgtgcttagtcaggtgagcgggcaaccaatcgggtatcgaccagtgtccttgcaagccttcagcgatatgtacaatcagaatggtgaggggccaatgttggcctcgatgtatgccggtggcgcccgcggactattagccacagtaagtgatgattatcagctgattatggatcgtcccgcccagtcattgctggattacttacaaacaaattatcagaaaagttaattaatcacggaaaattccaagcgagttaatggttgcgacgaaattccatgctataatttatatcaatagcaactttggaaaggagtcgccagtatgactaacgggacgcgtgcagatttacgtgagctttttcataaaggacaattaactattggcattagtgaactaagcagaatgactggtgtctcgccacgacaactacggtattggcaaaaaaaggggtacattattcctaagaacgaggatgagccgggccaggctcgcgtgtatacaatgaaaatggttatcaaggcagccgcgatgagtaatttattgcagactggttataccttgaaggcggcggccgctcaggtggatgagcggatgcgaccagcccaaacaatctatcatctgcttgccgatcgttaccaaggatatgaagtggcggataatggtcccagattcttgtcgacttggggccatttgatcctcagcctgaccaggaactatttgtcaaactcgtggggataaagttaagtttgaattgaaggataattcgagaccagatagttaggcaccatttgataatgagagttaatactagactgttctgaggaatattgtaattggatagtcttagcagcgtgatttcaggataatgaaatcacgctgcttttttatgattgatatcaatagttaattaattcagtaaatgatttgtcttcctgtaagataacgcgcaaaatcggggtaatattagtcacaataggattcgagattaaacttctaaagcaatcttcaagtatatggccgacagcacaaagaataataacttatgaaaggtacactagctacaagtgtacttttatgagcttaaataatgtatacggttacattatcatatgaattgtaaaagttagggagtgataaatttggcgccgaatagttcaccagcaactcttacacgaatgattattgagttgatattgtcaaaaaggatagttcactatcaagatattatggagtatacgggcacatctcgtaagacgattgctaagtatctgaatgaggtggaaaaggtagtcaaccaacaaggtgtacaccttgttaggaaaagaggacagggtattcgttttagtggtaatacgaagggactgttggctgagtttccgatactgaaggataatagccaaagtgagcaagaacgcagaattagcattatgacattcttgacacagcaatctaaaccagtgttattagatgatattgctgaccacttctttattagtcgtagtacgttggaacgtgatttaaatgttttaaaaatggattatgggttgaagctgacggccactacagaaggtgttaaattcaatagttcggagagtgatgttcgtcgagtgattggtcagctattacagtcatattggggacaagagattaagcaaaatcaacagactggcaaaatgacacgcacatttaaagtgccgcagtccctgaaacgatatgtcaataaacaaaccttaaatcagatgcaaaaagtcctgaataaatttgtgaagattttaaaagttgatgtaaatgaatatcaatatgagtctttactgatccatacaactattgcgattcagcgaattaagaatggcgagtttattactcaaacgacgacacagaattttgacactatggcaatatctccgagtaccaacaaattagttaaaatgcttatcgtggcctttaagtgtgaaattcccgatgaagaaattgcttatttaaatatgcatgtcgcggccattgaggatgggtacattgatctggatagaagcggcttagttgaacgaacgatagtcgactggctacgtagcgtgctaacggattatgataatcagttattacgtaatctaacgctacacttacgtccggcgctggttcgcattaaaaatggcattagtagtatttacgaatccgtattgtaatcaagttaaaacgtattttcccgtcgcttttgatcaagcactagcattagcgatggcgattgaaaagcaataccatttacagctaactgaggatgaaattgcatacttagcactgcactttgaatcgttcattgagcgccgaaaggtcttaaaaccagatgttgagcttgcaattgtatgtagcactggttatggtacggcggagttactaaagcaacgtgtcatggacaaactaccggatgttcagattgttggcactttgtctgtgaatgagttgatgacttcaacagtgactgcagacattattatttcgactatcccgttaaagatgagcggtacgagggttattcaagtcagtccgtttttgaatgaccaagaactcagcttattggaaaagttaagtcaagatattcgtcaagaaaagtatacgcggaacgcatttgttaaattattaagtccaaacggtattattacaaactttcaaaggcaactgaaaaaaagatggcgattattcaactaactgatcggctagaaaagtatgggtatgttgataatcaaatgcaaaattcagcgttagcacgtgaacaagttgcatccaccattatcgataaatttgcaattccccatggtgatatcgaccatgttttgcaaccaacgattggaatcatgacgtcgaaaaagggaattaaatgggatcacgaaaatgtccatattgtatttttcgtagccctgaatcgcacggttgaaacacaaatggatgatatttacagttatttctataatttgattcaagatgggcagcgaatgacggccttaataaaggctcaaaatgctcaagaaattattgatacattagcacagcagtgaaggggaaatgcaaatatgacagaaatttttaaacagaagtatatttttttaaaagaacattttagaacacgtgaggatgtttttagctttattgcacataaagcaattgacagacttggctttgcagataacgaagatgcagttttgaaagcgctgtatcaacgagaaaaagaagcttcaacaggaatgcaggacggtatagcgattcctcatgcaatctcagaatatctgcggcaactgctgtactattcattcgctctacaacaagcattcaagattggccgacatttgatgaccaaccagttaatcaggtaattgctatgctagttccaaaaaatagtgagcagcacacttacagattctagctaactttgcgagtgcattagtggatgaccgtgagcgtcaagcattacttgaaagtcaaacagttcaggatgtttacactgtattaaccaatagttcggaaaaaaattttataaaaagaggatgactgatatggattttgttgcaattacatcatgcccagcagggttagcacatacaccaatggcggcgaaagcgctagaaaaagcagcgcaggaactaggtttacaagctaaagtagaacaacacgggggtgcaatgggacttaaaaatgaaattacagttgaagaggcgaaaagcgcaaagtttttattgattggttcggatcaaaaattgaaaagatggatcgatttgaagggattccagcagttcgagttgatattaatatgtgtattaaaaagccgaaagctgttattgataaggtcagcaaagcggttgctgctcgtgttaaataaaatgaacttaatgaagaatggaggagtgagttatgaagaaaatattggctgagtggaagggctacttaatgtctggtatttcatatatgttaccggttgttattggcgggtccctcgtagttgcagttcctaagttgataggtctatgttttggaattacaagttttgatgcgtataaaactggtttttggttttatatgggacaaattgaagccgttggttggattggtgttggcttagttaatttagttttggccggttacattgcatatgctattggcgataagccagctttagccgccgggttcattgggggctcattagcatctagttctaatatgggatttttaggagccttggttgctgggtttgcagctggttatactgcacgttggtgtcacaataagttacatgttggtgaaaagttcgaatctattatgccattagttgttgtaccgctgctatctacaatggttgtggcaatattgatgggagtcattttgaagcaaccgctgacttggattaatgtatcacttgtcgcctggattaaacaaatgagtacaagcggtgtaagtgctattaccttagcagttatcatgggcgctatgattggttctgacttaggcggtcctgttaataaggctgcatggatggcgaggaaacgttttattagctgaaaagatttacaccccgcaatgatcgttaatgtggctattgctggtattcccttaggatatgcatttgcgacgactttctttaagcatcgtttttctgatgaattacttgatgctggacgaagcgactggttcatgggatttattggaataacagaaggtgctattccgtttacattagttaacccgttgaaattaattccaattaatatgattgctggtgctgctggttcggcgactacgattttacttggggctcaggctaagattcctcctgttggtggggtttatggatttgtcaccattacgaatggttgggcctatttaatcggtctaattgtttgcgctgcgattatcggtgtactggcaccattggctgtggactttaaccaaacacagagcgaagaacaagtcactgatgataatgaggacgacattaacattaattttgaagcttagattgactaaaacgagccgcataatggttaaagagccgtagtgcggcttttgttacctaaaataacagggagcgatacatttatgacaaaagcacattttgtaaatcatactcattgggatcgagaatggtattttacaactgaggacgcacaggtgctaagtgatcagctgttctcaaatgttttgaaggagttagaaacgcatcctgaagctaattttactttagacggacagacatcaatactagatgagtatgttgaaatgcatcccgaagatgttatccggataaagaaattaattaaccgtaatcaattatttgttggaccatggtatacacagactgatgcgatgatacctgatgcagaatcaattattcgtaacttagttattggcatcaacgataccaaacaaaagtatgggcaaccaatgatgattggctatttgccagatacttttggatttaattcgcaattgccaatgctcttaaatcaagttggcattaatgactttatttttggcggggcactaattttaagcgacaaatggactctgtttattttaaatggcacagtctaggtcatagtcaagtctatgctgctaattttccgttaggttactatactggtcaaatcgcattggattcgaagaaaaacttacaagttagagttcgttgcaaaccgtctagatccaggaattgattttgaaagtcaacagggtcaaaataattcggtcctagtgccttcgggaatcgatcaaatgaatattattcataacgtatccgagactattagtaagataaataaatatagtcataatcagattgtgatcagcaattatccgaagtttatgcgaacattacgacaacgcaacgatttaccggattatcaaggcgagttgcggtatccaacttatgctagagttcatcggacaattggttcagtacgttcgcgcattaaacggcagaatttcaaactcgaacagcaaatattacgacgtgttgagccactgatggtcatcgccaaaagatgtggtatcgatgtgtctaagggtcttattttgaaactttggaaaaagttgctagaatgtcaaccgcatgacagtttgggtggcagtgtttctgataatgttgctattgatattgaccatcgattcaaacaaggtttttgaaattgcagacggtatcgaaaactatatcaagaaaagaatcgcacaacggttgaaactggatgccaatcaggtgcttgtattcaatactgatccacgcccattcaatggatataagaaaatccgtttcttaacatcatcgaaaaacattatgtttgatgaaaaatatcaagcaactattttaagtgcaaattatgtggctaagcgagaaaatatcatgcaacaaacggctaaaggctttgaatttaaagacgagcctggttactatgaattacaagtacaagttgcagtccagtttgatgggttgggctaccaagtaattgactttaaggatggtgcagaagctttgccagaattacagtctgagcaacaaacggctatccaaaatgaaagttggaaagtgaattatgtcgatggcaactttcaggcaactactaatgggaaaacttacaaaaacatcattagtattgtagattcgggtaatgatggtgatacgtacgattattcaccgcttcgaggcgacaaagaggttgacttgcctttagccggcgttgtagccatttatgttggagctggaaggcaagaactgcgattaagcggcaagtggcagttaccagaaggcttggctgacaggattagtcacgaaccaaagctgcacgatgtcgcatttgaattaacgttgactttaactgatggtgacaatgtattggcgggtcgtttaactgtcgataatcaggttctagatcatcgattacggttaaaaattaatacagcaattgaaagtgacactgcagttgcgcaagttcaaggcggctttcaaagaacacgtaatttaccaattgcggaaaattgggaagaagaatttgttgaaaaaccggttaacctttataactttgataaaattgtcgggatgcaaggggctagcgatggcctgtatttaattgctaaaggaatgaaggaatacgagttaggaaagaaagcattttatgtcacattaattgcggcaaccactggtcaacttggtaagcctaatttactgtggcgaccaggtcgtgcttcaggcgatacaactagtattgggcatcagatgacaccaacgccgttggccgaagaattaggagcaaatacatttgagtttgggttagtttccacgtctcaattgaatgaaaataaattggcaataattgctgaaaagtggttagcacccgatgttagttatcaattacaaaaattgaatttatttgtaaatcgattagacaataaaatttgggatgttgaatttgatgattcattaccaactatctcagagtgcgagtcatttttgaaactcgatccacatgtcacaattagcgcgttgtatccggcctatactgtgccaaatagttttgttatccgtttggcaaatgaatctggtgtggctgctgatttgacccccttattaaaacaacatttcattcaggtaaatgctctggaagaggctcaaccatgttcggaacaattaatttgattcagccttatgatatggttaccttgctcatacacaatcaggggcatagctcatgcgtttgggaagtattgaagctggagggactaagttcattttagcaattactgatgagcactaccgtatcttgaagcgacaacgagtagcgaccacaaagccaaatgaaacgctggaagcctgtgtttcattttttaagaaaaatccagtcgatgcgttgggaatcgggagtttcggcccagccgatattaaggtggattcaccgacatatggtcagattttaaatacaccaaaagctggttggtctcatacggatgttgtacagatgttgagggcagctttgaaaattccaattacttttacaacggacgtaaatgcttcggcttatggtgaatatatgattggacaaggacaagcagtgcgttcactagtatactttactattgggacaggcattggtggtggtgttatccaagataatcatttcataggtggtatgtcttcatcttgaaatgggacatacaatggtcatacctatgtcaggcgataacttcaagggtgtctgtccatatcatcaaaatcggtgctttgaaggcatggcttcaggacccgcaattgaggctcgaactggcaaaccgggggaacaattgaagcgaaccaatgaagtatttaagttgatcagttattatattgcacagctggtctttgatgcatatcttaatttcatgcctgaaagaattgttattggtggctcagtagtaagcgaaactgaacttccagtgattagaagagacgttgagcagcttaataacaattatgttgaattaccgaacttagatcatttgattgttttaacgggaattgctaataatggttctgcaacgattggtaatgtcgccctggccaaaaatttgatattttaggtaaaaagagtcgataacaagtaacgttatcggttcttttactttactatgaatgaaaaatggtctggaatacttattttatatgacttgattcatgctacagtagaatctataaggatacataatataagtctacgcttagcatagccatgattaacttaacggaggaaaatcaatgatcaaattaatcgtaagtgatatcgacggtaccctagtcgacagtcaaggacagttattatcggctacaattacgggagttcaagcagcggttgcacgggggggcacaaatggtgttggcctcagcacgttcgcctaaggggatgtttggaattgcacaacaactaggaattaattcgaccatgattgcctataatggcgcgctaacggctacgaccgatgtgaatgatcgactaactgtttttgaagagcaagccgttgaccctaaactagcacaagctgtgcaaacggtagtagctcatgattggccagctgcctcaattagtatttattcgaataataactggttggtggctactaatggcccgtgggaacagcaggaagcgacgggaattggttatgcatcccccatgtcacggatttgggcacatggttgcaacggatgccgacgccagtgcataaaatgatgatcatggccgatccagatattattcaggcgattgaacaacgattaagccgtaatgaatttagcggcttagcagtttatcgttcgaaagaaacttatttagaaatcgttgcggcgggcgtaactaaagcagccgcattaatgaaattattacaggatgatcaagttacccccgctgaaacgcttgcgtttggcgataactttaatgatgttgcgatgctccagacagcggggattggtgttgcgatggctaatgcgccacaacccgttaaagaggcagcgaacatagtaacaactgataataatcataatggtattcagctaaccttagctcagtattttgctgatgttacgcgctaatgaaaaggccatttacgaatcattaaaaaataggaagctcaacgccatgttcgttgaacttcctattttcgtatttttggtagaagatatttaagagaaacctacagctagctagttattagcgcgctaagatttctttaatagctacactggcttccaatggttgacgtcccaagacatgagctaagtcggctgacttttcagccagcgcaccatcattgattggggattggaatgaggcaaacaaagcagcggtatcatgatttagaccagtcgtttcaaggaattgcacgtacgcatcctgactgacttgggtaatcttaacttggttgccagttgcttcttggagtgcttgaccgagtgcggcataagtgaggggtgtcccagcaaattcatacacttcttgaggggcatctgtcatcaaaacggttgctgccgcttcggcatattcacgttccaaggcccagccagctgtattattagcccagtacaaggtttcttggttatgggcaccactttgtaagaagcccatttcgttttctaaataccagttgttacgaagaaaactgtgcgcacaatattagtcgcttttatggcattttcggtggcccgatgatcattggctaaggcgctgactgctgcctgtgcgttgggaaaactagtgtaggcgacaaatttaacatgagcggcgttaagggcagtcacgacgtttttatgagcggtggcccggtcaacgggaccaccaggttgtgatgaaacgaagagcacgcgttcaacgttctcaaaggctttcgtcattgagtcgacatcatcgtaattcccgatacgaattggattatcaggaaacagctgagcagctttgtcctgattacgagcaattactaaaacattttctgcaccaactttagcattcagcgtactaacggcgctttgaccaaatttaccggtagcggcagtgacggcgtatttcataattaaacatcctttcaaattgctgtagcaataaaaattacagtgattagcttatcacatgtaacttcaaagtcaacaagtttgcttccaataaccgaaaagataccaattttcgtatgctgacatttaatgaatggctaagaaaaataaaaacgagtattagtgcgaatttctgtgactaatgaagtttcaccgctattgatttatgtccgaaaaaataggattagacaacttggtgttatctaatcctaatttataaaagtcagcgataaatggtggcgtttacttattattcaacgacgtcaaaattcgctgtgatgcctgtccgttgaagtcattggtttgtagccgttcaaaaacgtctttcataatgtgcattaattgttgatcggacaaaccttgggcagataatgtattgagcatgacttgcagcaagtcgattggcgggaccggtcgctgttcaggatgcgcactgaagaattcctgaacggcttggtcgtgtaagcgccagtaaactgggttttggacatcatcaaaaatcgtttttagttgctctagggccggtgatagcggaatgtttttggcaataatcgtcgttagcatctccatcacgagccggtatacgaacatccgccacgtaatcttttaatagtaagaaatgagtcttgaatggtggccgtaacgtaaaggtcatcgttaatgcaatttgactatcagtagctgccatgatgattcccctaatatgattggcagtgagtggcaaattaatgacgcttcgtgaagcggacgacggcttcgcaacgagctgtttgcgggaacatgtcgatcgattgaatatagtcgacttgatatccgcgggtaagtgcttgtaaatcctgagcaagcgtcgatgggttacatgaaatgtagacgagtttttccggtgcgctttgcaagatggcatcaattaagacgttatctaaaccagtacggggtggatcaacgaccattgcatcgggcgcaaaaccgctcgctaaccattgcggtaacaagacttccgcctcaccaacttcataatgagcattagtgatttgattgcgttgggcgttggcattggcatctgcaacggctgctggaatggtatccattccccgaacttccttagccacgtcggctagtgataaaccaatcgttccgacacccgaataagcgtcgaccaacgtctcgttaggcgctaagttcaaagcttcgcgtgctaagcgatagagtttcttggtttgctgcgggttcaattggaagaaggcccgagcagataaatcgaagactaggccgtctagctcctccgtaatagttggtttgccggccagtaatgttgtttggtcaccccagatcaatgaagttttaccagcattgatattttgcatgaccgacacgaccattggcagtttttcagcgattttcatcaataattgatgctttttcggtaacttgggtgtatttgtgatgaagaccagctgaatttcaccagtggcggccgcttcacgcacaacgattgtcttgacgatgccagaattatgttcttcatcgtaaatcggtacttggagttcctccagccaagccttacacgacttgacgcatgactgtcattgtcgccggcatttgcaccgaacaggtcggtaagtcgactaggtcatgactattttctttatataagccagcagcgacgtgcccatcaattaaacgaacttgaaattgggctttgttgcggtattcataaggattagtcatcccaatggtgggccgaacatcatagtgtcgataaccagctgggcggtatttttcgagtgcttgacgaattaaatcttgcttaaaggctaattgggccgggtagtcgaggtgttctaattcaaaaccaccgacttcgcccgcataggcatcgcggggatcgacccggtcaggactaggcttgcgaatactacgaatcttagcttctaggtaacgtgggtgcacggcggttacttcagcaacaacgacttcttcaggaagggcgcccttgacgaaggtgatgacgtgtttgtaatagccaataccttcaccgttaatgcctaaacgccgaatggtcagtgtggaaaacgctggccgatgttaacggtcgcttgcactttttcatccggctgttgtcggcgccgatcattgtgcgatcgggattggtgcgaataatgattagattgtggcataagtttgattttgacctcgtttttctgtgaactgtgttaacctccattatagcatgtggaaagacacaggataactgaggaggattgtttgaaagtcgcctaacagtcaggttataatgattctaaattagtaatcgggggtgggcatatgaattcattgattagtttagaaaaagttaattatcaaatcgctgatcaacatattttacatgatgttgattggcagattccagctggggctcatattacattgacgggaccatccggtggtgggaaaagtacgttattacggatcattgcggccatgatttctaaaacaagtgggaccttgatttttgatgggcagccgattgaaagctatgacccaatcatgtatcggcggcaagtctcatattgtttccaacaaccgacgttatttggtgagacggtggcagataacttagctttcccgtaccaaattcgtaagcaagtcatggatacgcaacgagtggtaacggcgttaaataatgttgggctgtccgaacgaaccccgcatcagccgattaccgagctttccggtggtgaacggcagcgggtcgcgctgattcgcaacatcttattcttgccaaaagtgttgttattagatgaagtgacagctggtttggatgaaaataataagcaaatcgtgcacgcctggttacgacagttaaatgagcaggatcacgtgacaacgatcatgattactcatgacgcgacagagattgctgcggcagatcaattagcgaaagtggttgctggcagattggaggtacacgcatgaatttagcagttaataatacgtcgctatttttggcggcaatgttagtgctcgtcgcgttaggaattagtttgtggcagaaacttgggccttggataaggacatcgtcattggtgtcgtgcgggctgttgtacaactatttatcgtgggttacttgctaaagtatattttccgagtcaataatttgtggctaacgctggcgatgataggcttcattatcttcaatgcggcttggaatgcgaaaaacgggggccggggattgaccatgcattagctatttcgttattagccatttttgttagtacgggggtaacactcggcgttctcgtcctatctggtgcgattaagtttgtgccatcgcaaatgattcccatttctggtatgattgcgtcgaattcaatggtcgcaattgggctggcttatcgcagcctcaatagtcagtttcatgaccagcggcaaggggtgcttgaacggttggcgttaggggctggtctactcgatgcttcgattgccatcgtgcgtgaggcgattcgtacagggatgtcaccaaccattgattcggcaaagactgtgggtctagtcagtctgcccagggatgatgtccggtttgatctttgcggggtcgatccagtacgggccattaagtatcaaattatggtcacgttcatgctcttatcagcgactagtttggggtcaatcattgcgtgctatttagcttaccgtaatttctataatgaacaaaaacagttgaagtaatgactcctgattgcagtcccgcggggagtcctttatgatggaagctgaaataaaacttaatgcgggggtattgatgtgaatgacgcagcggtttgggttccagttccagcaacgttttactggggctggttagtaccactcatatttggaaccatttttggttggcgttatcatcgcgataaggttcgcctaggtaacggtatttggttttcgctatttttctattcgtttttaaccatgctggcgattacaattttaggtagtaatatccactggttgatcattatcagtgggacgttgtttgtgttgctgatcctgttgattgggctgattttttaccttacaagccttcttgctcttatggaatgcgtggatcatgtggcgtcatgagagtcatacgttggcgaatatgctgaccttgtacttgggactggccattctgattttgccatttttaggcaatctgttgagtagtcatgtgccgcagcccgtgagttattttttgacggtatttccgaatctggtcattttttaccttggtttttggttttataactatctgacgatgctgacgatttatcaattcaattggccccgtctgcgacaagattatattattgtgcttggggctggcttgttagatggagaccgtgtctcgccattgctagggcaacgaatcatgcgtggactgcgcttttatcagaagcaacaacgcaagacgcatcatcgggccgtgatgattttctcaggtggtcagggtggtgatgaaacggttccggaaggccaagccatgctggaatacgccattgcgcatggccttcccgcaacggatggcctgggcggagacgcaatcgaagacgaccttgcaaaatatgcagtttagtaagcaattgattgcacagggccctgttaaaaatccacgcacgatttttgttacaaataattaccatacctttagagccgggatgtttgccaagcaagcgggtctaaaagcggatggtattggtgcgcggacggcgcgattcttcttaccggatgcgatcattcgtgagtatattgcgatatttgtccgaaataaatggtggcacgcggtggcgatgcttggtatcttgattgtgtcgctattattgacgtggtttgatgtctatcaagcatcgttatagcgattactaaggctgaatcagtaattaaaatattccaagtcaggtgtacgctggcttggaatatttttttggctggaatgttaaaaatgaagttatcgaaatggcagtatacttccattttaaaccgaaaaacagaaaaatggcagtatactgccatttttttaatggtgtgtagactaaatgttttaagggcaaacgtttttagtgaattcattttgaaaaaccaatttgtcttgacaattacttgaaaggtcgttatattaattatggaaacgattccaaatagggggtgagcctaaatgacaacgattagtgaaatagcagctgaggctggtgtaggtgttgggactgtttcgcggtatttaaaccatcggcctagtgtttcagttgctaagaagaaacagattcaggcagcgattgaaaaactggattacaccccgaatgccattgcgagtcagctacgcgcgcagaacactaatacgattggtgtactggtatcaagaatctctaaccccttctttgcacagttatttgatgcattggaacgggagttaaacggatacgggtttcaagtgatggtaatgcagactcatgatgatgcgttggcagaacaacactttctggataaactcaagcagcaacaagtggatggcgtcattctggcatccattgaaaatcaacaactagtggcacaattgtcggcgacgtatgctaatcagatggtgctgttgaatgaagaagctactgatattggtattccaatgatcagtttaaatcattatcaggcaactaaagatgctttggcatacttatatcatcaaggtcatcggcgaattgcctatgccacgggtggtgattttcccagtacgcatcatggacgttcgcggacgcaagcctatttagatttttgtgaagagcagcagttagttgtaaacaataactgggttttcgcacaacaacatacgattgcggatggacaagcgttggggaagcaattagcgtccttaaaccctagtgatcgcccgacagcggtgtttaccaattctgatgaggtggccgttggggtaattgatgagttacagcaacaacattttcgcgtaccagatgatatggccgtgatgggatatgacgatcaaccatttgcggcagtggcccaagttccattaacaacgattcgacaaccggtcgcggcaatggctcaattggcggtcgatcagctattacatcacttgggccggttacaacgacctgagttagcgattgctctaagcttagacttaatcaaaagaaaaagtgcttaagcctttttcttttgattaaagtggaatcgattccaaatataggagtagtaattatgcaaaaaaattggtggcaaaaagaagtttttatcaaatttatccggcatcatttaaagatgctaataacgatggcattggggatttgcgtggaatcatccaaatgttaccccggttgaaacagctgggaattacgactatctggttatctccaatatatcaatcacccatggttgataacggttacgatatttctgattaccaagctattgattctcggtttggaacgatggctgattttgatgagttgatggaagtaactaaacgattaggattaaaagtcattttagatttggttatcaatcatacctacctgatcagcacgtgtggttccaatctgcaattaaatcgccgacgagtccgtatcgtgatttttatattattaggcgtggggcacacggcaatccgcctaataattggcgatcaaactttggtaaaggctcgtcatggacgttattgccaggaagtcaggatgagtattatcaccatgtcttttctaaacaacaaccggacctaaattgggaaaatccggctctaaggaaacgaatctatcaaatgattaattggtggttggcaaaaggggttgcgggttttcggatcgatgcgataacattcataaaaaagatcaagattttgccagcattagtcctgatggtgttgatgggttaggtaaagtcaaacgtaaagctgaaaatcgacctggtattgaaaagttcttagctgaattgaacacggctacttttaaaccagctaacgcggtgacggttggagaggcttcggggttagttatgaccaacttggacaatttattgagtaaaaaggttacttctcgatgatttttgactttcattacgcagacattgatattgcatccggatcagagtggtatcgacgagttaagtggacaccgacggacttacggcgcgcaatttttaaaagccaactggcgattcaaaatgtcggctggggagctaactttttgaaaatcacgatcagccgcggagtattgataaatatattcagacaccagcttatcggaacgaaattggtgccaaagcactagccttactttattttaacttgcgcggttgtccatttatttatcaaggacaagagctggggtgacaaatgcacggcgtgactcaattaccatgtttaacgacttgagcagtcacgataactatgatcgtgctattgaagagggatattcagcaagcgaggcgcttgcctttgtaaatgctcgttcccgggataatgcgcgattaccatatccatgggatgattccgtcaatcaaggctttaatcagggtgggcgccaagccatggattacaccaaaacagtcacatgatagggtaaactggcaaagcgaacaattagattcaaattcagtttggcatttttatcagtcattgattaagttacggcaaatatcaaatttaagtcaggatttaatagtcggtgattttaggccaattacttgtgattgtgaccaagtgattgcttatcaacgtggtcgaagggtacaggtgtatgttaacttaagcgcaaaacggttattcctaacgttacctaatggccgacctcgattaaataattacgcacattatcgactcaatacgttggaaccatatcaagccattctttttgaggtgaattcaaatgagtaaaaactatcaggtacttgcgaaaaaaattattgatattgttggtgttgacaatgttgaatcggttactcattgtcagacacggttgcggtttgttgttaaagatcctaagcagattgataaagcagcacttgaagacttagatgaggttaagggagtctttttcggttcaggacagtatcaggtcattattggcactggtgttgttaacgatgtgtatgacgcgattgaaaagttacatttagttaatgcaatttatagtcaggaaacgccgactacgccgactcctgataatcagaagtcaccattgcaacgattcatggcaatgctttcgggaatctttattccaattattccggtgattgcagctactggacttttcttgggattacaaagtgctttgactaacaatcaggttttacagttgtttggaacttcatctgccgcgattccggcaagtcttaatacagtaatttcagttttaacggggactgttttttcatttctgccagctttaattgtttggtccacatttcgctattttaaaggtacaccaattgtcggtattgtgattggactaatgctcgtttccccttcactgcctaacgcgtattcagttgcgggtggtacagcgaaagcgattatgcttttttgacaagattccagttatcggtagtcaaggatccgtattaacagcgttagttgctggttttcttggaagtaaactggagcattactttcataaacacgtccctaacgttctcgaccaaattttaacgccctttttaacgatgttagttacttttggtattatgattttaggggttggcccggttgtacactggattgaaaatgtgatgattagtggtgttgaagggttgattaacttaccatttggaattggtggttttttgattggagccgcttatccgttaatggtgctagttggtattcatcagatgatgattgccatcgaaacgtcactattagcagctaccaagctcaatccgttaattactttagaagccatgtatggctttgctaatctgggggtagctttggcgatgattttacgagcaaagtcacaaaaggctaaggctaattttattggcgcattttcctcgcaactatttggtgtttcagaaccaacccttgttcggggtcttgattcgctataatttcaagccgttggttgtaaccgttttaaccagtgggataggtgctggcgtactgagtgttatgagtgtggcagcaaattcatatggtctagccgttgttccctcttatctgatgtatatttacaatgctcgtgatttgctgatttatacggtcgtctcgttattgacggtagcagtggcttttattgccactaatatgtttgcgattcctaaggacatattaaaatctgatcaagtacaaccaaagattgtagatgatacgatattttcaccagtttctggtaaaagtattgccttgagtacggttaacgatccggtctttgcatctaagatgatggggacggcattgcaattaagccacaggaacaggggccggtaaaagtctatgcgccacaaagtggtcagatgagtgttgtagccgatacaggacatgcctatgggttaacaaccaataatggagttgagttgttgaattcacatcggtattgatacggtgtcattaaaagggcaaggctttaaagttgtcgttaaaccggggcaaactgttcaaaagggtgatctcttaggtgagtttgacgcaacggtgttaaaagctgctaacttagatgacacggtcatggtgattgtgacaaatagtaaaaattatcaacggatagaatcagaacctaatcagtctattcagtcgggagcagcactgctggcgattcaagggcgtccggaaatgacgactgcaacagcatcctaaacgtaagtacgataaaaccgcgatttgccatgagcaagtcgcggttttatttatgcctttaggcccggttgagtgcgctaaagcgtgcgaaacaaaaaaccacccgctttgcgggcggatggcaaaatggttaaactcaaacgcccccatcagatttagaatgtaggtgtcagagccaaacattcaaaatcgaaaggggacgtcagaaatggcgaataaactaaacaaagccttgcacataccaagtggctgtgtaagtaccatatcgtattcactccaaagtataggagaaaaataatttataatcaatatcgacgtgacttgcaagatgatattcgcttgctatgccagtataaaggcgtaaagatattggaaggacatatgatgccagaccacgtccacttgttggtaagcatcccacccaaattaagtgttgccagttttatgggttatttaaaaggtaaatcggccttgatgatgttcgaccagcatgcgaatttgaagtataaatttgggaaccgacacttttggtcagtcggctattacgttagcacggttgggcttaatgaagccaccatcaggaaatatattcgtgatcaagaaaaacatgatcaagcgaggatcggttgagtgtccgggaatatgaagacccttttaagggtcaaggcaagtaataacaacaccgcttaaagcggtcgcaaaagtgacaagagcagtttggcttttggatacacaaaagccagcgccttgagacgctggctagtacatagggcttatagccctggagcaaactacccgttttacgggtagttatgattttgaaaatttgagtaagtgcagtactagcatggactagctagcactaaccgtaatatcaccattgctggtcgtcagtcggtattgtacgactgccgattggttgacctggtaatcaccgccatcggactggagatgattgaaaatatgcaagtccccatcgctagtgctagctttaacaccggttgtccgtggcgcggttattcgaatatcaccgtcactggctgtagcggataaactttcagtgatgcgattattattgagcataatatcaccttcgctacttgttagcttaagggctttgaactgattattggttagatggatgtcgctatcagcggttataattttgaagcagtcttggtaaaatgactgtcggtgatgctgatatctggatcgctattgatttgtagactaggcgccgagacacgagttaaccgtaaattatcgccggtcaacgtcagcgactgattgactttgacatccgttaaattaatatcgctatccgtactaagacttttcaattggtcgacggtaactttttgcaacgaaacgttaccactttgactagctttggcggttatttgatgaatagtagttcctttaggcaccgtaattattgtcgtgtcagcaaattgtccgacgttatcgaacatgaagccaacggttttggcgttgtgtgtcgttgaagtaacagtgacgtgaccattgttgatcgtaacagttggtaaggcgcgcgtggcggtaaccgtgatattagcagctgtgccttgcttaatagtaatattgttggccgttgcaatcgtgatatcttttagctgactgacgtggtagcgccgagtcttatggcgaaccatgtgaaaaccctggtcccaatagacgctttgaataccgttattggcaattcccgaaacatgattagaagcagtccaacaactaataaaataatgccaactctaattgtctttcgcatggtggtgacctcctcgttccgcccgatttttcttaacaaatcggtggtataggttttgtacgatttttgcaattccttgcagaataacgctaataagccagataaatagtggtaaaactaatagctcggcaccaataatagcaagaccgctacctaggtagaatagtgcgacccatagcgactggccgaagataccgatgccggctgttagcatggcaaatgcgaggatggtcacgccaattaagatggcacccgctgcaatcacgaatgcaaagacggtaacggccaaggcaaagaagaccgctaaaataactattaatgcgggaattgtgatcggtgttgataataaagcaagcacaattagccaaatcgtgcgtacggttgcttgagatttttgccgtttagaagtattggcgttgagattttcgttaaaacgaaatcgaataatcggctaacactttccgagccaattgtttaggcgttcccagttctgcaacgcaatcatcataattggcgattgccgcgtctagcaagtattcgcgataaaattcaacgacctcgtcgcgttcatcatcggtaagttgaacgagtaacgcgttaaatttagataagtagtcgttcatgattcatcctcccctgaagtaagtggttaatggccaaataataggtttgccactcttgttgaatcgcactcaattgtgtcaggccggcgctcgtaatctgataatagcgtcggttgcggccttgataggcctgatcgtaagtcgtgacccagtcatttttcttgagtcgtcgaagcactgggtagagcgtcgattcggacaccgagatggcggcttgcaagcgctgcgttagcgcgtaaccatagtaatcttggcctttaaggcgggctaaaacgcacccgtccaataactcggaactaatttgaatggccagtttgctattcctcctgctatattatacgtcgtatagtattgctcaatgagtagtatacagtgaagtgaaactaactgtcaaacttaaatattaaaataatgataaaaggtaaactacctttagccactagtaaacgcaaaatgtgcttgctaacggtgactgaaataggcccgtactaaagcttaaaatcatgatgctcagcgagtaccagctgtccggtacgcaagggtgatactatactgagctgataaggcctagaaaaatgactgatttcgatatataatcattatattgaaatattaatacagttaattgtcatggctgagttaattattatcgataatattatgacggagggcaattatggaaacggacatgaagaattgtgtggtttgtggtgaacgaattccccaaagtgcccagtattgtgaaaaatgcggcagtaggcaaccgacagttgctgaggataagcgtaaagacgcggaaacgacgactttaaagccagccgcatcatcaaaaaaagagcttacggacgtggtggttttggttgccaccagttatctgtgcgctagtcattgtctttgagattggatttaatttgtatcaggctcgggaagctaatacgcttgcagccaatattcaatcagaaatcagaacgaataaagctgaatatggcaaggttaaagtgagttggaatggtggtgccatgcgtgtgcggatatcaaagcaagcgccagttattgaaagtgtcgatcaaggcaagaccgcttcgtggcagtcactagccaagacactacaaagccgctctgaaaaaatcgcgaagaatcacaatcaaaaatattcacatattgaggttttgtcgcctaagaacaccaaatatatgtggttggaagtcaatcatggcaagatgaaattcaatattgcaaatcagttgaattagctgaccgggttcacgacataagcaatggtgtaaatggtcccggatggtttttagcaacacaaatgagtgataaaagatggtcgctgaaagacgccaacacacaaaaaagcccggttttccgggctttttgtgactatcaactggacgctatcaaatagattgcgatggctattggtttgtgacgttaccaccaaagtatttattagacagtttctttaaggtgccatcttgacggagttcttgaatcgctttagacagttgtttttggagtgaggcgtgctttttagtgacaattgcgccaatcttttgtgttttgatttctgaaccaccactaatgaatttcaagctggcctttggattctgcttgaggtaagcatagaatgcttcccgtgagttgattgttccggcgacgcgaccttggtttacgaggtcgatcgattgttgaaagccattggttggtgtgacggtcgcacctaaacgtttagcatcggtcgcgttattactagtcgttgtttgggcaactttcttgcctttgatatccgtgatcttgttaattgagggaccccttcttgaccgctaattcggatttagagtagatataaggcgtagagaagaggtatttttgtttacgttgcgcagtttcagcgatatcgttgatgaccacgtcgtatttgtcgacatccaggccagcaatcaaggagtcgaatttcgttgggacgaactttgccttgagaccgagcttcttagcgacggctttaccaaggtcgacttcaaaaccagtcaacttaccgtctttgcgatagctataaggctggaaggtgccttctagcccgatcgtcaacgtgccgcttttttgcaatttgagctgactactcgtgctagaagtgctgcttttagatgagctagaattaccgcatgccgtcaaggtgactgttagtgcgagtcctaaaattgttaaacttactgccttgagccattttttcatatcgattacccccgtagagctatttttttgacaaaaaagtcgtcctttatcgaaaaaggacgactgctgatcgtcgggtaccaccttagtttccaagcgcgtgcacaacgcttggctcaatgagctaattcactcagtacgctaacgggtacgacgcgttactggcttgctaatgctcaccaataccatttagagaccatcttcgtatcactgtccgaccgttttacaccaaccaacggctcgctttgcgtggcaatcacactactcatctcatcacaatgtttagatattgaggctagtctacaagattaaataacaattgtcaaatcgaaatcacattttatgttaatctaaatgccatttgttgtgaatgcgccagatcgatggttgatgtgagacgctaggggtgctaaaaaacgtgcatctgactgggattttccagttagatgcacgttaactcaaatgaacgctattggtttgctttgtctgaaatcgtggtgaacgtcatcgcggctaagaagtcggcaattcgttgcgttggctgcttaaagaattcagcgggtgtcccgtcgacacagaattttgccatcttcaacaaataggatcttatccgcaactgcgcgggcaaattccatgttgtgagtgacgataatcatggagtcttcttcctgagcgagggctagtagaacgcggagcacaccagcttcgagttcggggtctagcgcactagttggctcatctaacaagatgaattcgggatccatcgctaacgagcgcgcaatcgcgacccgttgttgttgcccaccggataattgttcggggtaggcgtcggccttatcttgcaagccaacccgggccaacaattctagcgcggactttttagccgttgcggaatcctttttaaaacttgcacggggccttccatgacatttttaacaacgctgagatggggaaacagattataaccttgaaagaccatcccagttttgcgtcgaatattgagaattgttttattagtcaacggcttagtaaagtcgatagtttcgtcattgaagtggtataaaccttgttcggggccgttcaagcaaatttagtgaccgcagtaaggttgatttaccagaacccgaggggccaacgatgacggtcgtctggtgttctgtaaattcagtattgatatcggttaacgcctggtgattgccaaacgtcttatttaagtgttctaatttgatcattcgacaacctcctaattaagtggccgtaagtaacgtgacgtccgcttttccaagtagccttgtagccagctgagaatcgtacatagaattgcgtatagggcagcaaccaggagtacatcacaagtggttgataattttgagcagcaatttgttggctgacttcgaacatttcaataatcgtgattgaagcggccaaggaggtgtccttgactaagctaataaaactattggatagtggcggtagtgagactcgcgcagcttgcggcaaaataattcgtttgagtacttgtgacttggtcatgccaatcgagtaggccgcttcccactgaccttgaggaatggtagagaatggctgctcgaatcgtttccgcacagtaagccccggtgttcagtgaaaaagtggcaatcccagcagtccaggggtcgagctggaccccatttggaaagagccctttgattttaaggtagggaagcccgaaatagacgataaagagttgtactagcagtggggtactccgaaagagccagacgtagaagttagcgatggcttttagaattaaaaaccaaccacgacgagtcgaaatcttgacgagggccgtgaaaatcgcaagtatcaaaccgagaataaacgaaataatggcaatcggaatggtatattttaaacccgctgcagcaatttgcggcgttgatgtgacaatgatgtgccagattgaatccatagggagcctcctgtaacaaattagaatttggtgctatgtatcccgccataatagcgggcaatggtacgttacttatcagtaacgttaccaccaaaatacttattggacaatttctttaacgtgccgtccttacgtaattcttggattgctttcgagatttgtttttgcatcttagggtgttgcttagtgacgatggccccgatttttgtgaggcaatgtgatcgccggaatcaatcagcttaatgttagccttcggattctgcttgaagtaagcatagaaggattcacgagaattaatagtcccagcgacgcggccttgtgagacgaggtcgatcgactgttggaaactatcggttggggtgatggttgcacctaaacgtttagcatccgttgcgttattgctagtcgttgtttcggcaactttcttacccttaatatcggtaatcttactaatcgatgagttcttcttgacggctaattgtgatttagaataaatgtaaggggtcgagaagagatacttcttctttcgggccgccgtttcggacatgttattcatgacaacgtcgaatttgtttgtgtctaaaccagctactaacgaatcgaacttcgttggtacaaatttagcttttagtcccatcttcttggcaacggctttcccgaggtcaacttcgaaaccagttaatttaccgtctttacggtagctatatggttgaaaagtgccttctaagccaatcgtcaacgtccccgatttttgcaatccgaggtcgttagactttgaactgctgctagtgttactaccacaggcggtcaatgtaactgctaaacctaacccaagcactgcaacgcttaattttttaacccatgacttcatgattcacactcctagaaatttttcacaacactcctagtttatccgaaaatgaagctgttaacaaaaaataagcattgagtgtcgcaaacggaccaatgcttatttcataatcggctagtatagcgttagtgtagcgaatcagagaaggactgtcaaaccctttttatcagtaaaagcgacgcaagcgcgggtgctcaaactgatacagtataaatggtcgtaaagcgtacggcttatttgatgtggatccctgatataaaaagtgctaatattcaggagcacgaccactcattacagctgacagatgtaatcaaaaatgcgactaatcgcaattattacggttagtcgcatgatgagtgggtcaagttagaattggggtgcgaacgatgctgctggaacaattactggtgccggttgtaagatgtggccaaggcgtttaattcccagcgtaattgtttcgacgtcgagactagtgaaattcaaccggaacccgtttttaaccttgcgacttgcgaattggcaagcggatggcacataggcaacgtgtgcttgcggtaaaacaacgtcattgagcaaggttttagcatcaattccttctggcaaggttacccagatgaagaagcccccattaggacgggtgtagtggacattttgcgggaagtattgatcgagtgcggctaacatcgcgtcacgtttaatccggtatgaagtactaatagttgcaacgtgatcgtcgatgtcgtgttgatctctaggtagctgttgatagcagccagtgttacatttggcgattgaacatcgattgcggatttcagtccgaccaatgcgtgcatgattgcgtcgtcagcaacaatccagcctgttcgcaaggccggggagagaatctttgagaaacttgagataaagatgacgcggccttcagtatcgtagtgtttgatagccggaatgttttgaccactataacggaggtcccggtacgggctgtcttccaaaataatggcgtcgtactgattggcaagggcaacgagtgcttgacgacgtttggcactcatcgtcgtacccgttggattgtggaagtcaggaatcgtgtaaatcaatttgatctcaggatgagctttcaaggttttacgaagttgacgaatattcatcccattatcatcaactggaatttcgtagtaagtcggttcgtaagtgtcgaaggcggctaaagcccccatgtaagtcgggccttcgacgatcatggcatctcacatggttcaacatgagcttcgccacgaggtcgattgcttgctgaccaccttgggtcatcatgacattgtcggcactaacttgaacgtcagcatgagtcgccattcgatctgcaatttttggcgtaatgccggcagcccttgagttgatgagtattggaagatgccttgaccatcgtgttcaatagcatcacgataggcttgctttaagtcgttgtcagggaataagtgctgatctggaaaaccaccagcgaaggaaatgttttccgggtttgcactattcttgaagacctcatctaggtcggaagtgtcattgtttaacacgcgatttgcaaataattttttcataataattttcccccactcagtttttgtacttaaactgttttctttgattatcaatatgataaaataaagcttgtaattagtaaaactcaactttttcaataataagtgaaataaattcacctaagagaggtaaatcattatggcaaacttcgcgcatatgaagtcttttcaacggtcgttgcccaacacacattctatcaagcggccgctacgcttaacgttacgccaagtgcggtcagtcattcgatcaatcagttggaaaaagaactgggttttccactattcatccgtaaccgttcaggcgttgaacttactagtgatgggcggcgggttttaccctatgttcaagagattctgaatacggaaagtaacttgcgacaagttgccgataatattcaaggattgcactctggatcggtacggatcggcggtttcagtagtgtctgtatcaactggttaccccgaattattcgcgaatttaatcataaatatcctgatattaagatttcagtcatgcaaggtaactttaatgaaataaccaactgggccaagatcggtactatcgatattgggtttacgtcgatgccagtcaatgagaacttattagtgcattcactgatcaatgatccaatctattgtgtgacgcccgctgattttatcccagaaaatggtgaattcattacgactgatgacgttgcggataagaactttattctacaacaaagcgattatgaccgggacaccaagctagcactggaccactaccacgttactaataactttttacgattctcgattgatgatcaatctattatttcaatggtagaatccggtttaggcatgggcattttgcctcagctagcactacggaagctaactggagatgttaacacgttttcctttgccgaaccttataatcgtgagattgccttagttgccaacaaaacccaggcggccgctccttcaacggctatcatgattcgtgctattaaacagtttttgaccaaggagtatccggatcagatgttatggcagtagcaaagttaggcagagcgttggcgtagccagcacagacttcagtggcattgagcatgtttcgggaagccactcgaaaggtagatgaacgaccgcctaactggtgcaattagtcgttagaattattatttactactaagaactttgaacaaatgttaatgggacatcaactgttttgaatacctcagtataaagatcatggaacagtcgtaattctattatcagactgacagttatatggcaaagtcgctgtcgctaaaatagccacggccaattcatcagaaacggaatacgcacatgtccgccattcgaacgctatcccgactggaaagcgttgtaggacgcgctcaaccaggcggggttggcactaacttaaactttttcagcggacttaagctggctgcttttaacgttaaaggcttactacgaccagatcgcacaattaaagctaaaaatagccgcttttccagtagaccaagttggttgtcaggaaaggtggctattaatcttttagatatgttttagataagcactctgagcaaaaatgatggctaggtcgattggacgggtgaaatcagtttataaacgtttgaatcgtattaccgatttgatggttgtttgagagtaagccggattgggtgcgccatgagcgcaacactttttgttgatagacctttaccactggcttgaagatagattgaccagccagggcactttgcagtggtaggggttggtcagctttgatggcttttccagcgacaatcaataccgcatcttggaatcaatggtatggcggtgtgcaatcaatttagctagtgtggccgtttgcgacttggcggcaaccggcgtcgtttggcgacgattgttactttggcggctggcgccgttaaatggggcggccatcagtacaaggtgttgtggtgataagcttgttgttgtgtgttcgacatagttagtggcagtgagaccgccacgaccgtaactgacaaggttaaaccggcgaaatttaaactgctggcgggcggcggttaggagttgctttaataaatgcgtttgtcggtttgaatcaaggttcttgggcagttgcacttgtatgtaggggcggttgtcactgttgagcaagttgccctttaaatgtcacggtccccgtcgctgtaattttggcggtgaccagtgtctgagtggcgctactgttttgaatatgggcagttaattgctgaatctgattgtgagttaagtggtcatctagtaagagcaccattggaatacgttcagtagaagtcactgttatggtggtgaccggttttgacttgtggacttgttgttgccaaagcatggtaccaccgatcattgctagcagaactactagccaggtagcgcctgtcaatacttgttttgtcgttgctttcatatttcccgttactccatatctccaaataaactgcacttttaatgtaagccactcacagtcaacttgcaactgtttatacacacttttagatagcaaaagtcccgaccaaatttacttggtcgggactccttaaaggtatcagtcatgtgctccgaatagggcagagactgatgctttaagattacatatggtactcaaaaagcatcacccccctttcattattaattgtccgtagtttagtcccatttaatggtcaggtcaactaattagttcgcaaacggactaaacgcggtataatagaattccttggcgggggcactccgcggttgcggggtacttaacgactgaattttcagttgaatgaggtgcatcgacggattagtcgggcaccttttacgttgtcgcagttaaacggtgatgccgtgagtgaaattagtctggaaagttaataaattaattctagtcacaataagttaacggttaatcaagatggacctaaattttcgatttatgattagcagaattactaaaatttagaatgaaattgggcagacataactaaaattctcacggttaccagcactatctggacggggcctttcaataaattggtacggcctaattaagaacttaagcttttctttaaaaagtgctaccgcaagtgcgtattaaatggtaaattaatagaagtagttttgtcatatttcttacattcatagggaagagggattattcacatggtctttaacttggtagttaatattattgggattgtggtttttattgccattgcctacttattctccaagcaaaagcacgccattaactggcgttcagttggtgtcatgttagtactagaagtcttattggcatggttcttaacgggttcacaagtcggtgtcgacgcggttaaagcagcggcagatggcttcacttggctcgtcaatgtatcatacgatgggatcgcctttgcgttagctagttgggttaacgttaagtcgatggacttcgtcactagttcattattaccaatcttgttgattgtgccattattcgatattttgacctatattggcgtattaccatggattatcaaatgggttggccggggcttagcttacattactggtcaaccaaagttcgaatcattcttcgttgttgaaatgatgttcttgggcaacacggaagctcttgctgtttcgcagttacaattggaagcagatgaaggcacaacgaaacttgacgattgcgatgatgtcaatgagttgtgtgacggcatcgatcttaggggcttacattaagatgatgcctggtcaattcattttgacggcggtgccaatgaacgtcttaaacgctgcgattattgctgcaatcttgaatccggtcgatgttaagccggaagaagataccattgcgaaaatctcaggtagtgcggctgttgaagaaactactgccaccactgaaacgagcggttctgaagaattagctaatgaacaagttaaggaagctaaaccagctcgcgaaccattcttctctttcttgggtgattcaatcttaggcgctggtcgcttgattttgattattgctgctaacgttattgctttcgtagcgttagccaaattaattgataagttgttaggtttaatcaatagcaatttatcacttgaaaacatctttggggttgtcatgttcccatttgcatggttacttggctttttaacccaagtgatgctttccaaatggcttcatatatgggaacgaaattagtgactaacgaattcgttgtcatgggtgaagtttccagcaaagttaacgattttgcaccgcatttccgggcagtcttaacggtcttcttaacgtccttcgcgaacttctcaacgattgggatgattattggagctttcaagggaatcgttgatcgtgaaaagaacgatttgatttcacggaatgttggttacatgctattatctgggatcctggtctccttactatcagccggtgtcgttgggttgttcgtttggtagtcggtgatataatttaatcttgaattaaacgtaagagtgtcagctattcggctggcctctttttattaatgaatcatctggtcatacttttatccggtgtcgtttttaacggtgagatgttcaaggcggttcatgaatttgactagaaaaattgcaaactagaatagctgtcaatgatggctgtaaaagcgaagacttttcaagggttattgcgattttaacagcggggctgtgcattgattttaagtgttatttacgttaaagttatgaggtgacgtgaaacattgagttgtttcacaaaaagaggacgaatgtgacccctttaaggagagctattactaatgaatccagaagaatttaaacaagcgttagcccaacacgagattgcgctgacggcaaaacaattggcacaatttgcgctgtattttcaactattggtcacgactaataagcagttcaacctgaccacgatcacagcggaaccagaagtttatcttaaacatttttacgattcactcacgccagcattctacgttctgcgctgcgtgatcaaccactcacgatttgtgatgttggcgctggagccggtttcccgtcggttccgctcaaaattgcgttcccacagttacaagtgacgatcgttgattcattgaataagcgaatcaattttttaaatgatctagtccaacaatttaggcttaacgggcgtgcaaacgttccatgatcgcgctgaaacgtttgctggcaagaagtctgctcaccgggaaagctacgatatcgtgacggctcgggcagtagcgcgcctatcagtattgagcgaactctgcctaccactcgttaaaattggcggccagatgattgcattgaaagcagccaatgcccgtactgaaacggctgaagggacatacgccgttcaacaattagggggccaaattgttcaggacgaggcctttagtttgcccgtgactgctgatccgcgccatatcattgttattgataagaagaagccgtcaccgaagcggtatccacgcaagccggggacaccggcgaaacagccgttaacggcaccaatgtaaggtgggaggtaatttcaatggcattttcattatttggttctaatcgtgataaacataaaaccgaggcggccacgacccccacggagcaacaaattgtccgtattccggtcactgccattatccccaaccggtttcaaccccggcaagtcttcgatgaaactggtattgctgaattggctgctacgattgcggatcacggcttgttgcagccaattgtcttgcgggaatacgaaccgcagaaatacgaaattatcgctggtgagcggcggttccgcgccatttcttcacttcattgggcagatgtgccggccatcattcaaaagatggatgatggtgaaaccgcgtcaatggcgctgatcgagaatttacagcgacaagatttaacggccattgaagaggctcgggcctaccaagaactgatggaactcaaccaattaacgcaatcggcgctagcgaaagaattgggcaaaagtcagtcgttagttgcgaataagttgcgattgttgaagttagcacagccggttcaaacggcgttgttgcagcgacaaatcagcgaacggcacggccgcgcactactcaacttggctgtggagcaacaggctgcggttttgaaaacgggtgcttgctgatcaattgacggtcaaagaaacagaacagctagtggcgaagacccaaacgccgccgaagcccaaacgcaaacgtgcacggggttgaccggcgatacgcgaattgctgtgaatacgatcaaaaaatcaattaagatggtaactgatgccggcttacccgtgaagacccatgaagaggatacggatgacgggtatcggattacgattgaaattcaaaaaatcaaccaaggggtgatcaataattatgggaaccgtaattgcactcgctaaccaaaaaggtggcgttggcaagacaaccacgagtattaatctcggggctagtctggtcgaattaggccaaaaagttttattaattgacacggatgcgcaagggaatgcgaccagtggtttaggtgttcaaaagtcgaccatcgaacgtgaaatctatgacgttttaatcaatgacgttcccattaaagaaaccattatcccaacgagtcataagggtttagatatcgttccggctacaattcagctttctggggcagaaatcgaactgacaccgatgatggcacgtgagacccgcttacgtgatgccatcgatgacgtgaaggatgattatgattatattttgatcgattgtccaccgtcgttaggcttgctgaccattaatgcgtttacggcttgtgattcgattttgattccggttcaaagcgagtactatgctttggaagggctgagtcagttattgaatacgatcaagcttgtacaaaaacattttaataaacagttgcgaattgaaggcgtgctattgactatgtacgatgcccgtaccaatctcggagcccaggtcaacgaagaagttcggaaatactttaaggacgccgtctataagacgattattccccgcaatgtgcggttatctgaagcacctagccacggcctatcgattgtcgattatgatgcccgttcgaaaggtgcgcaagtctacttagctctagccaaaggaagtgttggccgctcatggcaagtaaagataaagataataaggcgctgggacgcggtattggagccctgtttgccgatgttaacgaaccagctagtgaagaagccgtggttgatctagatcttaaggatattcatgccaatccgtaccaaccccggcgaacttttgatcagacggcacttaaggagctcgccagctcgattgaaaagtccggcgttttccagccaatcattgtacgacaaccggatgccgagctgaataaatatgaaatcattgctggtgaacggcgttttcgggcgtcgaagctcgctcatcaaacgactattccagccattgtccgtgatgttaccgaagaacaaatgatggaagtagcggtgcttgaaaatctacaacgggaagatttaactccgcttgaagaagctgcggcctacgattcgttgatgaagaagctgaagttgacgcaggcggaagtctcaaagcacctaggcaagagtcgggccatatattgctaattatttgcggttattgggcttgccagatggggtcaaacagtatatccaaaagggccaactgtccatgggccaagctcgaacgcttttgtctttgaaggataaaaccaagttagcgccattagcgaagcgcgtcgtgaaggataacatgacggtccgtcagttggaacaaatcgtggcgcgttataacggcgagtccaaggagccggccaaaaagttgcacccaagaagtcaccgtacatccgtgcgagtgaagaacaattacaagagaagtttgggacggccgtttcgattcaaactaaggcgaacaaagctgatcaagggaaaattgaaattccgtacttgtcaaatgaagatttgacacggattttagaaattctcagtattgatttaaattaattaatttataaaggggcgttgcgcatgtatgatttaggtgatattgtcgagatgaaaaaggcgcatccgtgtggtgtcaatcgctggggaaattacccggatgggcgctgacattaagattaaatgtacgggatgtggtcacgtggtcatgatgccgcgtcgtgagttcaataaaaactcaaaaaggtattagaaagcaaagccgatcaagcttaattattaaaaaggaagagtgaataaccgatatggcacttacagcggtatcgttgggttaccaaacgttggtaaatccacattgtttaacgcaattacgaaggcgggcgccgaaatggccaactatccgtttgcgacgattgaccccaacgttgggatggttgaagttcccgacaaacgactagaccgaattcaagaaatcatccccgcaaagaaggtcgttcccacgacttttgaatttacggatatcgccgggatcgtcaagggtgctagtaagggtgaaggacttgggaacaagttccttgaaaacatccgccaagttgacgcaattgtgcacgtggtccgggcctttgatgatgacaatatcacccatgtgacgggtaaagtcgatccgcaagatgatattgaaacaattaatctagaattgagtttagcggacttagaagctgttgataagcgtttggctaaagtgcaacgggctgctaaggggagcgataaagaagctaaggctgagctcgctgttttgcaaaagatcaaacccgccttggaagccggcaaacccgtgcgttcactagaattcaacgaagatgaccaacaaatcgtcaagggcttattcttattaacgtctaagccagtgctgtatgtagccaatattgccgaagatgacatggccgatccaaaaactctaagtatttccaagtggttgcggactatgctaagcaagaaggagcccaagccattggtgttgctgctgaaactgaagaagaaattgccgaactagatgatgacgacaaggccgactttttagcagctgaaggcgttgaagagcctggcttgaataagctgattcgggcttcttacaagctattattaggactgggactggaaaccttcttcacggctggtggtaaggaaacccgggcttggacgtttaaacgcggtactaaggcccctcaagcagcgggaattattcactctgattttgaacgtggatttattcgggctgaagtgatgtcttacgatgctttggatgaagccggttcagaagcaaaggtcaaggaaaatggtaagctgcgtttggaaggtaaggactatgtcatgcaagatggcgacatcgtcgaattccgcttcaacgtttaagctgaaaggagcaattgtatagtgagtgagagcgaaacttcaaagacacctaggaacgccgcggccggggccaagcgggctcaagccgcagaacggccagttcacgaagcgactgagttgacgaagcgcaatgctgaatatatgcgtcagatgcgcaagtcacttgatgccacagcgttgagtggtgagaaaaagacggcagttctgaatgaaatgacgtctacattgttagcggaacaagggtcggggaaccacggctcgtcaattatacgggaccgttcaagaacggaccgaagagattgtgaatccaaaaagacaccggtagaacgtcaaaaggcgaactattgggtcacggcgctggataatggcttaatgctattcatgattttctgcttaatgtacgggatcatgggcttcatcggcacgaacgctactaagaattcagctggtgccaacgggatcaccgctattctgattacgtccgccattggtggtttgggcgttgctaagttattcgaatacttaatgcccgctaaagatggcaagaaagtttcgttatggaagaaaatcgcgtggtcagtactggctatcatcgtttggatgttagtctttacaaccatgtcaatgattcaaggaccattgaacccggtcttaccaggaatcgcgtacttgatcattgccgtcgtcgtcttcttcgcccggatgtggttgaagcggcgctttaatattacgacgagcatgtttttaggctcggactgaaagacaagctgatggcgtgcattggcttgtctttttgtcgattgcaagtggtcattgcttgttattcacctagttagcttttaaactggtgatacggatgtaatgactgaatgaaagttgtgtgtgaagtacgctcggcccaacctggaacattcggttgggcgttacaggtttaaaataagaactttctgaaaatctgcgcaaccccttgcatttatcgcgatgttttgttacctttacagataaaaataaaaacataaggagctaacgttcaatgtctaattgggatacaaagtttggaaaaaaagggttatacgttcgatgatgtactattaattccggccgaaagtcatgttttaccgaatgaagtcaatttaggtgttaaacttgccgataatttacagctgaatattccaattattagtgcgggaatggatactgtttcagaatccgcaatgggaatcgcgatggccaaccaaggttgggcttagctgttatccataagaacttaagcattgaagcgcaggctgaagaagttaagaagatcaaagcggtcgttaaggatgatgatcacccacacgctgccgttgatgccaacaatcacttgttggccgttgcggctgttggggtcactagtgatacctttgaccgggctgaagccctatttgccgctggtgcggacgccatcgttattgatacggctcatggtcattccgctggtgtgcttcggaagatcaaggaaattcgggcccacttccctaagcagacattgattgctggtaacgttgcgacggcagaaggcacgcgtgctttatttgaagctggtgttgatgttgttaaagtggggattggccctggttcaatctgtacgacccggattgtcgctggtgtcggggtgccacaattaacagcggtttatgattctgccagcgttgctcgcgaatacggcaaagctatcattgctgatggtgggatcaagtatttcccggtgatatcgttaaggccctcgctgctggtggcaacgccgtgatgcttgggagtatgttagccggaacagccgaagcaccgggtgaggttgtctttgacgatggccgtcaatacaagttctatcggggcatgggttccgttggggcgatgtcacaagctcatggttcgtctgaccggtacttccaaggcggcgtgaacgaagcgaacaagttagttccagaaggtgttgaaggacgtgtgccattcaaaggcagcgttgatgatattatcttccaaatgttaggtggtttacgttctggcatgggctacgttggcgctaaagacattgatgccttgatcgaaaacgcccagtttgttgaaatctctggcgctgggctccgcgaatcacatccacatgaaattcaaattacaaagaatgcaccgaactattcagtcaacggttaaaatgacgatatcgtatgagtcagtctgattggtttagttgaataagcatcaaaggtaagcgtagaacatcaactttgttctacgcttttttgtctggtgagtaccagcagaaaatataggcagatgtaacgttcgtgtagattgaccgtagtgcttctttcttgttaggacgttgatactagctctgtacacgattgtgttacttattaagttcattagatttttaatgatatcgtggtattagtgatgcaaagaaaggggctaatataaatgaagtatcggttaataggggtaggtgcgagtctagtcatcgcagtcatgttaacagggtgtcaagcgaaggctacgacattggtcaagtcagatgctggccaggtcacacaagcggaagtatttaaacaaattgaaaaccaggcgacgacgcaacaggctgttcaagaattgactctaaacaaagtccttaatcaacgatatcatgtttcacaagctgaagtaactgctaaattaaaagcattcaaacggcggcgggcgcaaattatcacatgattttagcaaacgtaatcatgtcactgaaccgcgtttaaaatcgcaaatcaaagcgaatttattgatggagaaagccattagtgctaagtatccagtgactaaagcacaactaaaaaagcccgagcagcttatatgccaatgacaacggttcaacacattgcgacggccaatgagaagcaagcgcaaaaaattattgctgaactgaatgcgggtgctagctttgattcgcaagtgcgaaaatatcagaataatcgacaagcgcacacaactgctggaaaattagcgcagtttgacagttataatcaaactctagcaccagcaattgtacaggctacagccaaactacgagtgggacactatgtcacgaaaccggtccaaacagttatggaaactgccgacacgaaagacaaaccaacttatgaaattatcaacgttgtcagtcgtcgatctaagactgcggctgtaactgatgatagcggtaagcggattgatgtgacaaattatttgcgtgaaaaatccagcaacagcggatgatggacaagcagacgcaagttgcgacgattcggtcagttttcaaagcggcccacgttaaggtagttgatgcccatttcgcaccagcgtttaatgattatttaaccacccaaaatagctaacaatagaatcatcagcaatgatgtgatgattatgaacgcgtctcttaacctgtcatgggttaaaaggcgcgttttcgttaggtactgatgattaattgcgctatgatggacttattaaaacgtattgtaccagtttagtgaggtgccaaattcaacatattaagtaggtgagtagatgcaacggtttcagtcacgccatttattccagttacgagaaattggcttgggcttaacctgtatcggtggctttattgacgcatacacattcatccaacggggtggtgtcttagcagctggtcaaacgggtaatttgatttttctcagtgttgatgtggcacagtggaatttaccgggtgtgttgactaaattagcaacagtcctctttttacactaggtgtaattgttgtgggtatactgaaacaatggttgggcgcgcggtcacactactggcgcttgcccgttttggtggcagagctggttgtttgtttaatggtcggcatgctaccagcgactgttagtaatgcgatggtggtcccaccactcgcattcgtgatggcgatgcagacgacagccttcagcgcaatcgccggccacggctataataacgtgttctctactggtaatctcaagaaggcaacgatcgcgctgacgaattattggttgacaggcgtgcgcacggagcttgacactggtttagtgtattgggaattagtgttgagctttgctacgggcgcgattgtttcggcgatattgcagcggtggtggacattacggacgatatgggttgcggcgggattattgatcttagtaggtggatactatacttggttattagttcaccgtacggcaaatgacgcggaatagttgcgttttctctaaaatcaatcgttaactgccaagcccggccgcttttttggtaaaataaaaacagaattatttaaggagaaaaataagatgaaaattttagtagtcgatgacgacaaagaaattgcacaactattagaaatttatattaaaaacgaaggctatgaaccaattagcgcctataatggccgtgaagctttgactaaattaaatacgaatcctgatattgcgttaatgattttggatatcatgatgcctgaaatggatgggattgaggtcatcaaagaagtacggaaagattcccaacttccaatcctagtcttgtcggccaagactggtgatatggacaagattcagggcttgattacgggagctgacgattacgtcaccaagccattcaatccgcttgaaattatggcacgggtcaagtcactattacgacgttccgaaaataacgtgacgactaccgagcctgatattttggacatttggaccgttaacgatcaataaagattcgcacgaagttaaaacgttgacgggtaaggatattcaattaaccgcgttagaatttggtattttgtatttgctcgcaagtcatcctaaccgagtcttttcagctgatgatatttttgaacgtgtttggcagcaagaaagtattgtctcagctaagaccgtgatggtgcacgtgagtcatttgcgggataagatcgaagaagccacggatggagaaaaagtcattcagaccgtttggggcgttggctataagattgaatcgcgttaagagtgagggttagcttttgaaattaacgggacgcgaaaaaaagtgaattattttttgaaggggtagtgacggtgattttgctactccttttaaacttgtcgatcgtagtactgatcaacagtacgattgcgcataatccggggttacagagcggtattttccaaattaaacgatcgattaccattggtcccaataactacccagctatggagttatgaaaacatctttattggactgatgctgattgcggacggtttcgtattatattggcgattaattcgacgatacaaacagatgcagttacgacatattattagtgagttgcattatattgcggccggccactttgaccatcggattgactttaatctgactggtgatacacaacgagtcgttgaaagtgttaatgccttagtagactcggcaatccactcgatggacgaggaacgggaaattgagcggtctaaggatgcgttaattacgaatgtcagtcatgatattcgaacgccgttgacgtcaattatcggctatttaggcttaattgagaacaaacagtaccaatcagaagaggatttaattaaatatgcgcatattgcctatttgaaggcaacacaaatgaagtcactggttgaagatctgtttgaatatacgaaatcacggcagacagagacaccgttggccattaatcggttaaacttgactggccatgttagaacagttagcggcaagctttgagctggaagcgaacaagaagcatctgaagattgaagtagaaagtggcacgaagcctatttacattgaagccgatgctgaaaagctggggcgggtcttcagcaatttgatcactaatgcgtttaaatatggaactggtgctaaaaacgtagtattacaagctgaacaacgtggtgaagaagtcgtgattcacgtcacgaatgatggtcagcgtattccagctgagtcgttgggacgcttatttgaacggttttatcgggttgaagaatcgcgttctaaggcgaccgggggttctggactgggcttagcgattgcccaaagtatcgtggatcaccacggtggctatatttatgcgcaaagtgatgatgagcagacaagctttgttattcatttgccagttaaacatgaccacccattaacaaaaaaacaatcggatatgataaattaacttgtttccacagacataatttaatttaaactaaaactagcattagcaattaagaaagggataattgagaaatgagatttgcgggaaagttaaagaaagttatgattgccctcgttgcggcagtcacgtttagtacagctggtttaggcattgcgggggctgacctccaggcccaagcagccagtacaccatcgatctctgcgaaagccgccattgcggttgacgcgtcgaccggtcagatcctgtatgataagaacagtagtaagccaatggcgatcgcatcaatgacgaagatgttaagtacatatttagtgcttaaggcgatccatgaaggtaagttgtcttggaatcaaaaaatcagtgttagcaaggcagtcgctaagatgagccaaaacacggaatatgcgaacgtaccgttattatcaacgaagacgtattcagtgcggcaattatataacgcgactgaaatctattccgctaacgccgctatcacagccttgggtgacgcggtagccgggacgccccaccataagtttgttagcttgatgcggaagacggctaaatcatggggatcacggacgctaccattattaatgccagtggattaaccaataaagaggttggcagcacaattgggtacagtaacgttgccgccagtgctgaaaacgaaatgtcagcacaagatgttgctaccgttgcgcaaaagctattatcagattacccagaagttttaaagacttctagcattgcccatgcttggtttgaaaagggcactagttcagcaaccaagatggataaccgaaactacatgctcaaaggattagttaaacattactccgcacttcctgtggatggtttgaagactgggacttccactaaggctgggaatgccttcactgggaccgttaagtttagcaatggtaaccggatcattacggtcgtcatgcatgccggtgccgctaacgatagtgggacggaacgtttcactcaaacggctgaaatcatgtcatatgtttaccacaacctacacgactacgacgattaacaagaatggcaagatcaatggtgtgaaagccgttgatgtccaagatgggaagtccttaacgtcgcaactcgtttcaaatagtggtgcaaccaagatttacttgccaaccgggacggatgctagtgccgttactggtaaggtcagcttgaagaagtcggcgacaaccgatggtaaattacaagcacccgttaagaatggcaagactgtcggtactgttaacttgaacctaagcaagaaagctatcaaggtagttgacggaacgactagcaagaatatgaccatcaatgtaacgcctaagaagtccatcgacaaagcaaatatctttgtacggatgtggcgcggggttaagagctggttcaactaaattatagcagttagtgtattagattctgtgggtgcattagcttagtaaacgctacgagatatttcttaaaagatatattcctctttgagtaggcaagctagtaattgagacttgcgccctgctcaaggaggatttttttgttggcaatagtgattcatgacaggcaactaatgaccagggctgtgccactgatttagctaattaaaaataattagcatccagagtaatttcaaaaaggcactgtcaaggatgaccaagttgaacggctgcggatgttatgataaaaagagtattaatagtcttcatttggcgatgctaaaaaagcaacgtttaaatcgggataattatgaggtgctttgttaaaaattattccctaaattaggccgtgtgcctatcttagtcactacttcgactattcgctacaagcgttccagtttgagcgttctttctttttttgctaatatttgaatgctagctttggataaattgcggttccatttatgtagaatttgttagcatgatccacgattaactgtataatgaagactgataacagtagttaaaccgaatggagtgaaagtcacctatgagcgtatcattacgaactgcaaccatgtcagatttacccattattgtagatatttacaatcaaacgattcccagtcatcaagtgacggctgatcttaaaccagttacggttgagcaacgtcgaaattggtttttgagtcatacccctgaacactatccgctgtgggttgttgtaaaggacgactcagtggtcggttgggttagtctgtcaccattttatggacgggcagcgtatgcaaagacgactgaaatttcagtttatttggatcgcagtgttcaaggacagggaatcggtagccaggttttgacattagttcctaaacaattacctgtgttgggattaacaacgattattgcttatattttttcaagtaatattccaagcattaagctgttcaaaaagtttgggtacgaacagtgggggtttctgccagaagtcgctgaattaggtggccgaccgaatgacttagtgattctgggacaacatttcaagtaaaaatggtattgataccgcttacatacactttaaaaaaacttaacaaggtgtaggattgcaataaaaacatgttaaaattaagtccgagtgtctaagtaatttgacgctcgctgttgttgctagaattctttactggtatggtactggaggcattcttggtgaaaaagaacgagccaaattggttagtggtattacgaacagtaatgccacttgggcttagctatattcccatcgggttagcttgtggggttttattgcatgcggccgggttcaaccatctactgacggcgttaatttcggtaatggtcttttccggtggcgcccaatttttaattgcatcgatgctgacaattaatgcaccgatgacaaccattattttgatgatgtttttcttggagttacggtacgccttattaggttccagcttatcgcgctatctgaaggggcaatcattaccgttcatttttacgtttgcgttttcgatgaatgatgaaaattacgcggtcaactatttaaagtttgcgacggacaagcattggaagccatcgcgtgccttaatggtcgaacactattcgttattattttggacggtaagtaatattatcggtagtttgattggcagtgcattgacgattaatctccaagtggtggattttgcgctgacggcactattcatttatatggcaattatgcaaactaagagccgcttgattatcttagtggcagttttgtctggcgttctaacgataggttttctggtcttaatgaagagtacgctgggcctagtggtgtcaacactactcgcgtcgttgaccggttactttattgaacgttacttgttggcacataagccagaaagtcatttactctataaggttcacgatcctactggccaaacagccatggaagaatctgacaagtagggcacagaggggtttttcttatgcaatcagtcagctcaatgagtagtatggaccatttttggttggtcattttttgtgcgtgtgtggctttcataccacgctttttcccgcctactgttctttacgaagcggaagatcccagaatggtttaatgaatggatgcggttcgtacccgtctcactattcacggcgttagttgttaaaagtgtctttatcgatagtaagtacgcagtgatcacttctggcaatctggggatgattatttctgctattctcgttggatttgtggcttatcgcacgcgttcaatgactttatcagtggtgattggtctagtctcagtgatgatttttgtgttactaattcatatttagattttgttggaactgggtgacccggttctttttattatgatgaaaagaggatacgttgatggtatggttattggttttcttacccggattattggctggtctggtccaagggttaacgggctttggtgcggccatcgtcatgatgatctttttaccacagttgtttccgattgctcaaagtgcggccgtggcgggcgttattatggcagccagtgtcataacattagtttggcgttatcatcagcatatccactttcgtcagattattgtgccgtttatcgtttatgccagtgtggcggcctattcggtacatcttggtcaagttttagatgtgcaattattgcgacggttattaggtgcgctgttagtttcgttagccgggtactttagtctgagcaaacgtgcggcgaatcagacttatccgtggtggttagccggtctcttcatgattatttcggggtttttcaatgggttattcggtattggcggcccgctgatggccctttattttctatcacttgccgatacgactacggattacttgggaaatttgcagactttctttttgatcgatgtggtctatatttcgacagtccgcgtactgaacggtattctgacgccattcttgctcccccatattatgattggtatggtaggtgcggtcattgggacggcgctggcggcacgaatcgccgcggctacccatgacgacagtccggcatttgatctacttgttcattcattggacttagtggtgggtattatttgattgcgccagtttagaacgaggtatttatcaccttcattacgagttgattttagtggtcaggcgcaatgcgtttggcctttttgatggtgcaaatcgtccaagtgttaaaaaatattttcagaaagcagcggtagcacttcgacaatctgtcttcggttataaacgagttaatcccaatgtataaatttaatattattaatttaataatcaagaatttgccagctacagctggaacagcgcttatctgttttgggagcagacgtggatgcgtaagatagtgccgttgagcgtacctgactgtagcttcttaatcggccttgcgcacggttctaaagttgaacaaccgggattgaaatatttattgttgaagattttttattttaacgatgcttaattacaggtgctacatagctgaaaaaagcattggcttattggtttccttttagtatagttttattctaagaactgcttaaattggggagatatatgaatagctacagacgaattcaagttattgcggggatttacttgctgatatacattgcggcactttacttttcgacgggggttcaggttggatttaagctggatagtaatcagctcactgggtatgtgagctgtgggctgttgctggctgtaattatggggtcagggtttggcaaacgattaagggtaaaaagctattttcgattttgatactagttagttgtttgattattctagggataaccagattcaatgttgtgagttttaacgaggccttctggtactttatcttatttgttcgatacatcccgttcattgtgttgattgaaaccatcatctttatctttgacctagattgagcaaaccaggccctaatgagcattcaactcattagggcctggtcttttattattctaaaacctggttatgccgaacttttagctggcgtgagtctatatggcaactacgctaatcttcgtccggtaatcgtacctagaccgtattgataaagtagttcatcagtacgattaagatcaaagcgctgactaagtgcgaagatgaccagagcatcccattcatccttagcataaaggacggcgtaaccagttcgcttgagcatcgtgttaagctcggtcagggtcagttgaaaaccgaatccgagggcgatgatgcgagcccggttaggtcggcgcttgccatcgaagtactggtaaccaatcgagggcgttagattagcgcgccgaatgacttggcttttagtgacgtgtttgatttgaataagctcggcgaggtattccgccggattggtacgaataaaactattggccatatttgtcataaattggtcggcctcacttgcatgtttgatttcgttaaatagttccttagttgcgcgttctaccacggttagtgccccctaatactccttcttaattagtattagtgtaccagaaactactgtaatttaaaggtcaaatgcccgatcactgaagtagctgggattgtagatgagttcaacggacccatctgctttggcttgaccagtcatggtaccactgacagagccaccagcggtcaggtcaccactatctaattggttattttcatcaatgttgatctcatctaggctagtttggttaccggcggccttgattttaaagtcaaacgggttatagctgactttatctctaccgctatttttcaatgttacggtgaccgtataatattgattgccagttttaggctgaacatcattgagcgtcgttgcggttttaacattattaaccgttacttgcacgtgatcgatggtggctgtctgcccgactttataaatcgtatttgccggggtttccttagcggtggacttgctagcgctggtctttttggtcgtcgctgcttgtgagtttttaccgtcttgtggagaattgacgaggctgatgacaaagaagatgccaaggagaatcaggacccacgcccatcccatttttgataccaagctttcgtttttgcatgagcttacctactttcttagtgctaagccgcccgcaataacaatgagtagaccgcttagaatcccgaagaagctgacaaagacgaagttaagaatcccacaaaggatgatcaaccagcccattaaaacgtgattgcgattaatcatgacacttaaaataatcgcgaggacagagacaataatgcagccaacgccaagattgctgaccccagccgatccgctggtttctaaagcactaccgatgccgccgatggtcatcgccagtaagccggcaatgataccgaagataccgccaataattcctaaaactaattcggctgttcgcgactggtgtgcgactggtgtgacttcgttattctgatattttgacattgtaattcctccaaaagtatggttatgataaaagttagtaattttgataaaaagggggtgtcacggtgttaccgattgttcaagcaatgcaattgttataagtacggctggttatgaaccactaggaccattagttgcgcaacgcgagtttccgttactggttaagaagcaacaggttgtttcggtagctaaactagtaaatcctgataatgttcctgttctacagcgtttgaagcagcagccaattccccgaatgccccggatcgaagcattattaacggcgactgattgcattgtaagtgttgagaccttaattaatggtcaaacactagtggatcgattggccacacaaggaccgttttccccgaaatgacggtgcgcgtcgcacaagaattgttgataacgctacaggcgttggggcaacaacaaattgtgcatcgggaccttaaactaagtaacgtgatgtgttatcgggatcattactatttgattgacgtcaacgcagcgcgacaatatcatgctgagcaagacagtgatactcgtttattaggcacgagcggttttgccgcacctgaaaactatggcttcgcccaaacggtaggaatcaacggagcgatctatattcgttaggggtcgttctaaactgtttgttgactggtcaagagccgagcgggccgttagatacaacgacactgacacaggattcaacatgggccccgattattatgaaggccacggccctagacccacagcaacgatatcaaagtgcgactgcaatgttagcagcgttacctggtcatgagcattatcggccgcaccatcaatcaatgattaagcgaatacaggcccggcaatggtggccgaaaatcaaacgacctttacaaatcagtttgtggggcctctacatcttgctcgtagttgcgaccattggtgctggctttgataacacgacttggcccgcccgcgtcgatttttggaccgagggttttatgattatcggggcgccactgattgcgcactatgccaatcagtggctaaaacaccattggtcggtattacgctggcaccgatatcggtggtggttacgagtagcagaagccatcttcatatttttgatgttaggccgtaacggctagtgtacgtaggctggttaaccaattactagtacgataaatagcataaccgtttagttatcaaaaggcttatgcaaaatgcataattttctgactgcggtgttgataacgttgcgactgcgttggcgcgacgactgaattcggctgggtaagactttactcagtcgaattttgatttataggtcaggaaagtgattgaaaataatcctgaaaactgttgatgtgttttcaggattatttgaggagacgattgtatttatggtacaatgctagtcgttgacacttgataacataaatatatctaattaaatataagaaaggaatattttgtcgaaatggatttaaagcaaagcgatggttggcgatacttagctgggtggagcttcattctattaatggtggcgagtgccacattgcaacatgatgcggaaatcattttacccgaaatcggtgctctgacagccgggacgacgttgggtttatcgtaagacggcgtggactcggcaacccttaaagttattcttagtaccatctggaactgcaattattggcttcttagtcaatcaactaccttggtcgtacgccctcaaagtgcttgtcggtctattactgatgctattattattgaaggggttaaaatcgaatttggcgccagcctttgctactggcttactgccaattatcattaatgcaacgcactggacctttatcgtagccatctttttctggactatttgcctgatgattggggcttgattcaacgaccgcgatcaatctcacgggtaaccgaagcttctgctagtcgctggcaaatgctcggctttatcagcctagtttttgtctgggtgggtattgtttggctagcgggacagccccagatggccgcaatcccacccgtgatcgtcgttttctttgaagcggctcaacagtctgaatatacggtaacgaccgcacttaagcagtggcttgcattgtcggctgctgctagtattggggtcggcattcacctattgattgcttcgtggctattaacgacggtcattgccttaccacttgtgtatttgtggttacgggcgcttaacttacaattgccagcagcgtatgcctttccactattagccttagtgttaccagccaatatgtttaacaaactaccgacatccaccggtttagcggccgctttcttcctaggatcgttactcatctaccatcagatcttgggttgggtacgcatggcggtgactgaaagctagttgtcagtcattcctgaaaaatggtcaaaaaaataccaactatttcgaaataatcgagatagttggtattttggcatttaattaagctttattgattcggttatccgcatacatgtatttccgggtcattggtaaggttcgtgatgaagcacctttagttacgaggtactgcatgacgtcaatgttaccagactggaaggaagcggcacaggcttgtaggttttagagatcccacatgcgagtgaagcgcacgcccatcttttcttcgatggcagcgcgcttagcgttaaagtttttatcccagatttcagtcgtccgttggtaatggcgacggagggtttcaacgtcagcgacttgtaagccggcgtcaacaatgtgttgtaagttttcggtcatcccaggaacgtagccacctgggaaaatgtacttatctaaccaaccgttagtggcgccaccttgttgccgggtgatgccgtgcaatagggcaacaccgtcagctttaagatagtggttaacgcgttcaaagtacattgctaagttgtccttaccgacgtgttcgaacatcccaacactggtaatgtagtcgaaagtttcgtcgccaagttcacggtaatcttgtaaccggacttcagcaacatcactgaggccttcatccttgatgcgttgagcaactaggttatattgttcttgtgataacgtgaccccgacgacttttaagccgtattctttagcggcagtcaacatcaacgtaccccaaccgcaaccaatgtctagtaaggtcttgccaggttgtgggttgagcttttgaatgatgtgatgaaccttatgaatctgggcttcttctaatgtatcagtgtcatgtttgaagtaagcacaagaataggtcatggttggatcaagccacatcttgtagaagtcgttacccacatcgtaatggctttggatgtcttgttgactcttcttttcagagtgagattgtttaggcatgaacttcttgaacttagaattgttgaagaaactttctgccgattcataggccgattcaattaatttttgaatactgccatcaatttcaatcttgccatccatataagcttcaccaagggcaattgaagcgttcttggtaatttcacgcattggaatggcttctttaaaagtcaccgtgacttctggtgtgccttcaccataagtttcactacttccatcccagtagttgacttggtgacgggcatattgaatgagtggcttagaagggtgtggtaaaaggtttttctagcattgcaataaggatcctttcttcgtaaaatacactaattattatacgcttatgaaaacagttttgtaagcacaacgaatctcgacctgattcgtaaacatgttataataaattaattacaaaatcagttgatgggggtgtcgtgatgaaaagatggatgtggatcgtgtttgcagtaattatcgctgtgggggttggtagttattcatatacgcggtaccgtctgctgggaagactcatacacggctgaaatgcgaactggtgagcgggcactgcaagcgcggaattatacgttagcggagacgagttttacacatgcgaccagaacgaaagctagtagtactgaggcgcaacggtatttaacccagacccagacttatgtggctggtcaagaagcactggctgcgcggaaatttgacgtggctaaacgtgactttatgacggtattaagacgaccaagcacggtgcagttacgttaattaatcaggcccaagaacaacttaccttaataaaaaaggtgcaacaaaaacgcaagacttatcaacaacagtatcagaaagctgctgagctgaataaagcgaatgagtttacggattctaacgttgtaattgctaagttattgcaggataaggcgtttaagcaacgttactatcaggatattcggaaaaatgtgttggatttacagaaacaaaataatgcgtcactcaagacattgaccggttcagcaccggtgatcccgagtgcggcacaagcggttacggggatgaccggaagtcagcaacaaacgcaacgcacgccagccactaaacagcaggcggctgcttcatcatcaacttcctcagctaaccattcgatgggctcgtcagctgcagctaacaacagttatggtgacagtcaagtgcagacgactcgtgctgagttgactgcgcaagggctcgacggcagtaagttatagtgatgcccaaattcgtgctattctgcaacgagcagcggcacaacacctctcactggcgcaagctgcccaaacgatgaattatagctctgatcagattcaggcaacgcgtgcggagctagcgcaagctggatttaatgctagtcagtatacggatgcccaaatcgaggccattttacaacaagccagtttacaacatatgtctctggcgcaagcagcgaggtcgttgcagtaatataaacaatttaataacagtatggaagtccacttaacaatcatcgataaaacacctacttttaggtgtcaatcggtgatttttttataaaaactgttatagaatgtaggagtaaggacggaaagttttcgttcttgatattttggttctacgggggcggtcattttatatcggtattggccttttttaacgttcatatgtcaaaatgggtataaaattgactattttgtgtactatttttgtttgatgctatagaaatattaacagattaggggttaaggtgcccgttgatgattgaattaatggcagaccaaattaacatgatttggtaaagtagttcgattgtcaatggtgggcatcgaaattcagtatgattattaataaacatgtaatgcgcagtacgaatgaaaagcaagttctgcagcgggttattaacgaaggaccgattagccggagccagatttcacggaacttgagtttgaataaagtgacggtttcagatatttataatcagctactgcggacccagttcatcaaggaaattggctgtggtgtcagcacgaaaaacggcggtcgtaaaccagtgatggctgagctgaacgtgaactatggttttgtggccagcattgacatgacggctgacgcagtcaaacttatgtattcacggttgaatggtaaaattttgcactttcaaagctttaagacgagcgatatgacgttgacggatgtcattgatttgattgaagatcaattacggaaacgttgatgactatggtacgattcatggtctgatgggggtcgccattgcgctggatgggattatttatgagaataaaatcctcaagacaccgatcaagggactaacacactttgatctagcaaagtatttacgtgataagctacggattccggtagttctggaaaagaaagctaacttaacggccgtttttgaacgtgatttccatgacaatgagattttcgataacgtggtttcagtagtcgttcgcgatcaaattcatgcgggaatcgtggctgattcgcgactatattctggtcatgaaggcgaagcaggtgaagtggggactgctttgttagaagatcggcacgttgaggaccacttggcatccgttaacgattatgcttctgaaaaagccttgtgggctcggttgaaggccatcaagcatgtcgaacgactagatttgacgacggtcaaacatgactacatcaaccatgatccggaagtgacaaaggtcttcgatctagactttgtttactatctatctaaggtgattgcgaatgtttccacggcgttcgcgccagatgtggttgtgttgaacacgaccgttctagaaatcttgccacaactattgactaatgttcgggagagcacggccaagctaacttcgccaagtcggcaagttccgatcattgcaaccaagaacgtacagtcggcggccttgttgggtggcgcctcagttattattcaccaagcattaggattagagagcttaaagatgcagttctcataagtcattaagtgtttatttaaacgaacgtgtgaagtttatcgagtgattagtgataaacttgacacgtttttgtcgattcacaacggccttttaatttttattgctgagactttccgttagaataggagtaagggatagtagaggggtggatgttgtggaattttggtcacagttaatacgaaatgtgcgctggcggcgcgcccgcgtattggcgttgattgtgttaacgctatacttggcatcaagtatgatgagtatcattttattaacgtttatttttacgttcttagtgacgcggttagttcgggcagttcggcggtgggtgaagattccaccgacgatcattgtcctagtggtctacgcactagtcattcttggaatttactttgctgtatcgatttatttaccgcagttgatcaaacaaacttttttgacgtttgaatcagtctatcggttttatcagaacccatcacatgatactaaccaagtgttgacgtgggtgacatcgtattttcaagagtcggatatactcaaacaattgaagggcggtatttcagttgtgttccagtatattactaatattggtaatatgggactaaccttcttcttgtcatttattttgagcttcttctttacgattgaggatcatcagatgcgggtcttcacgaagcgctttttgaccagtacgtttggctggttctttcaagacgtccatttctttgccaaaaagttttgtgtgaatagctttggcgttgttttggaagcgcagttcttgattgcgattgtcaatacggtgattacggtagccttcatggcaatcttgaagatgcctcaactgattagcttgggattaatgatctttattttaagtctgattccagtcgctggggtgattatttcagtcgtaccgctgagcttgattgcctattcggttggcggtttgcgctacgtggtctatatgctcttaatgattttggttgtgcacgccttagaagcctatgtcttgaatcccaagtttatgtcgagtcgcacggagctgcccatttttatacgtttgtcgtattactagtgagtgagcgtctgtttggtgtctggggactgatcgtcggtataccgatttttaactttattttggacatcatcggcgtgaaaccggttcaccggccgcgacctaacattaatctgaaaaaaacgattactttccacccggattctgaaaataagtgctgatattgctttttgatttttcgctttttcagtgtaaaatagggtgagtaaataacttaagaaagaggtcattaactgctatggcaaaattagtattgattcgtcacggtcaaagtgaatggaacttatctaaccaatttactggttgggttgacgttgatttaagcgaaaagggtgttgaagaagctaaggctgctggtcaaaaagttaaagaagcgggcttagaattcgattacgcctttacttcagttttgactcgtgccatcaagactttgcactatgtgcttgaagaatccgaccaactctggattccagaaaccaagacttggcgtttaaacgaacgtcattatggtgcattacaaggattgaacaagaaggaaaccgctgaaaaatacggtgacgaccaagttcatatctggcgtcgttcttatgatgttttacctccattattgagtgccgatgatgaaggttcagccgttaacgatcgtcgttacgctgacttagaccctaaacatcgtccctggtggcgaaaacttgaaggttaccttggaacgcgttatgcctttctgggaagaccaaatcgcacctaagttattagacggcaagaatgtaatcattgctgcccacggtaactcattacgtgccttaagcaagtacatcgaacaaatcagtgatgatgatatcatggaccttgaaatggctactggcgaaccagttgtctatgactttgatgaaaagttaaaggttcttggtaaggaaaagttaggcaaataatttaatagttatttactagtttttggagcactccgctgtctcaggggagtgctttttgggcgccaagtgccgataacgtctgatgaggttggcagttggtggcaaatggacgctagttgtcattatgaaaactaagatttttgtttcagaaagtaaccggtcttatatatttagataaaatcaattatgatcaatgatgatgaagagtcacttgaaggtttgaggattcttgaccgagcaattgttaatcagttaaattaatgaattaagagtgatggtcgctaactggtcactacttgatgaaacagtgattaagcagtaggggctgcgcgggtaagttcaaattaagtccccaaccctcccggtcaaacgtggagattggaaattgagaatttaaaaggggataaagctgaatgaatatcaaaaggtacgggatcgatgcgccgtttgcgctattgatctacaccgcttttggtgtggggctagtgttacatgcctacgtaaatcggttgaactatccgattggcatcgaaatgacgctgggaattatattattgttgggtgcgttattatttttgcacaccacggcacaggggaagtaccgactgtttgatgaggcgattcgccacttgaacttgacacctgacagtcaggtcttagacttaggctgtggtcggggagcactgttgaccaaaatcgcccaacaattgggaccagctggcaaagtaaccgggattagatctgtggttgtcgcgggaccaatcacataacaaaataaccgtaacacaaaagaacgtggatgatttaggactaacgaatcgagttaatttagtaacggggatatgaccaagttagactttcctgacgcaagttttgacgtggtgacgtccagctttgccatccataatatcaaaaatgaacaagcccgaatcaatgctgtcaaggaagccattcgggtactcaaacccggtggacacatcatgatcattgatacgggtcgcaatatcaacgagtacggtcaggcttttcgagacgctggcttgcaaatcacccagtcaatgagtttaggatttaacggttagtgggcgaccccgctaattgatagttacgtggtcgctggcaataagccaacaaataaaacggcaaaataagattaaagaagagaattggagttatagttaaatatgagtgaaaaagcaacagaagtaacacaacgtgaaatgattcgaattattggcttgttccggaagcaaggatttaaaggtaattacctgagtttccagcacgtcgtcgatgaaggggccacatatttcgttgtcatgggtgacgagaacaacggtaatcaaggcttgttcaaagctaacttattaacgggtgaggttgctttccagtatatgctggatgaagatcacgtcgtaagttcaaaataataagtttctggagacacaatgaccgagtctggttgttgtgtcttttctgttattaaattggtctttattccatcacccaaattagagctagccttttaacaacattattcgtataattatctttgtctattcccgcaaaagatgagattattgaacgttcacttaatttaaggagttaatcatgaattttgtttttgatatcgatggtacgttaagttttgatggtcggactatcgccctacccattacacaggcactaacctacttaattcgagcgcaccataaagttgtctttgcgtctgctcgaccaattcgcgacttacttcccattattccagaatttgagcatcagcccttaattggtggtaatggtgttatgacccgggtttcagaaaagttatccgttctccaaccattaccacccgctgctgttcaacaattgaagcagctcatagaaatttaccacttagattatgttatggatggcacgtggaattatgccagtcaagtttctactgacaatccaattttacgtcaacttgatcctcaacgattagcccaacgccaatcattagcttctttaaatgatccggttaaagttattttattaaatctagctccagtactgcgcgcaagaatcaagcgattattaataacactagatctagtcgtcattgaacatagtggtgaaggaagcttggatatcactgcccaaggaattaataaggcccacgctttggctaatattggttttgaacactatattgcttttggcaatgatgaaaatgatcgaatcatgttagggttgtgcccggcaagcagtttggattactagtaaacccgaattagcacccacccccaagccataatatgcccccagatgctgaatccatagcagcactaatttcaaacttaagtgatagaaacgactgccgtgttgaatagatcagtcatccattaaacacatattcatggttttgactgaaaaagcaacagaagtaacacaagtgaaatgattcgaattactggcttgttccggaaataggggtttaagagcaactacctgagcttccaatacgtggccgatgaaggtgccgcgtacttcgttgttatgggtgacgaggacagcgacaaccagagcttgttcaaggctaacttgttgactggtgaagtggctttcagtacaagttggatgaagaccacgctctaaggctgaaaatactttaaaattaataacggtagtttatcaatcggattatcaatacgcctttagtttggtataacgattgagaatgtatgttcgaaacagggaggaatatccaaatgaacaaccaggtattagaaacaatcaaagccaaagtttgctatacgctgttagtttttgaacgtgtgaataagaaattaggtctaaatcaagatgcagagcctacgaagacgatggttaataatgttttggcaaacctggacgatattgatcggtggggcaagaactattatgtgcgaagtcgtcagcatcaggtggaactaacctaaccatcaatgtatcaaattgccggctaattacagtgtctaagtatggctaaaggcggtagtagtaaatatttgaagtcttatcaaggtgtcggtgttgtagttctcaaaactagattaactgtaaagatattgtttgctgattgaatactcattttgccaccaatcgaagtaattagggattgtacgatacttaaccccaaaccgacgctttgagtggtccgggcagtatcagttgtgtagaaacggttcgttaattggttaacgtcacaattttgggtagccgggttgtgtttttgaattctaataaaatgtgatcattatccctaggttttaaggtgattgaaacggaatcagtagcatatttcaaccaattacctactaggttttgaatgattcggcgcattaaaacttcatcggtgttaatggaaatatttggtgtaatcattggtgttaacgttaaatgcttctcgtttaaatcgtcaaaaaagttaaagagttcaatctctaaaaaatgcgagaggttaattggtttgaaagcgacgttggctgatttttcctgaagtaagttaaagtccattaaataatggagataataatttaccgatgacaagttatgtgcaattcgcgttagagtttgtggagttgcaatcgacggttgatgttgaataagttgaacgtaaccaatcgcaaccgtaagcggtgtcttaatatcgtgcgtcaggttcaacaacatttgctggatctgatgctctttttgatactgatttgtttttttttttttttgaagcaaacgagttttattcaagacggcattcaacgcagtggttagttgttggatggctgaaaatcttgtattactagttacgctagcattagtttcgtgttgattgatatactgtaaatcagcacttattcggcgtaaatctattaataataagattagaactgttgaaagaattgcaataataacgattaagctggtgataataaagttaatcatgatagactcctaattaaattaaccgaataccgattccccaaactgaaatcatgtattgtggattggtagcgagttcgttgattttaatgcgtaaattgctgagatgaacgttgagggtgttttccgcatcaatatatggctctcccaaaccatctcataaatttgtgctttttcaaaaacttgatgtggatgctgaagtaatatctttaaaatgttaaattctttttaggcaaaattaatgggtgatcgttaatggagatttcatgagtagttacgttctataaataaatttcattgaacgacaaaattttgttgttgagattattaatcaaattaggtgttcttaattgtacttgtacacgagccaataactcatcaatgtcgaatggcttggttaaataatcgttagctccagcttgcagtaaggccacggtttttgtcttatcttggatagcggttaacacaaggatgggaacgtttgaagttttacgaatcgtttttaagacactttcgcccgtaatgtttggaagcattagatctaggatgattaggtccggctgatggtcagcaaaggattgcagagcactgataccatctaaagctgcaaatacttgatgttttggactcaaaatgtcatgaagtagtgcttggatatctgtatgatcttcaattaccagaattttagccattgtccgtactcctttattgaaacctgataactaaattataggtgacgtttcgatttacgacaatttaggttttattaaggtttatttatagcatgtagtttagaaaacttgactaagctaaaggtggtaattaagaaggaggatcgaatcatgatgaatgatgtgattttagatattagagcagttagtaaacgttttggtaattatcaagcacttgagaacgtaaacctaactgtgaaacgtggggacgtctacgggttgattggtgaaaacggtgctggtaagacaacgttgatgaaattaattacaggattatccccttgactcaagggcagatcacattgttaggagagtctgcgcagcattatcattatgcgttacgacgcactggagcaattatcgagacaccagtagcctttccgaatttaacagtccgccaaaatttaaaggtttgtgccattcaacatggtttacaagatgcgcaaattattgatgaaacgctagaatttgtgcatcttgtaaaaaaaaaagcggactagagctaaacatctatccttagggcaaagacaaaggttaggtttagcgttggcgatatgctaccgcgaccagatttcttagtcttggatgaaccaattaatgggcttgatccaaccggaatcattgagtttcgacaattaattaaacggctcagtgaagaacgcgataccactattttaatttcaagtcatattttatctgaactttatcaagtttctaatcgatttggtattattcatcatggtcagctgattaagcaagtgacaaaggaagaactcgatgaggctaatcaagccggactcatgtttgcggtggataaagttcaattggcgagtcaaaccttagatcagagcggctatgcttccttcgatgtattggatgatcaacgcattttaattaaagacaataatgtcactgctgcaaatgttaatcaagttttagtggaaaatggggttgcagtgaaggcgtttacccaccaagagggatcgttggaacagtattacacggacttgcttgctaaggaggattaacgacatgctaaatcaaattagagcagatggctatcgacaattgcatacactcggtatctacatcgtattactggttaccgtgattttcagtgcattgattacgtcgggacaaagtgttggtggaattatgattaatgcggacgatatcaggatgaatgaacttagtaagagtgattggtcaattctgactggcttaagaagcgcaacgctgtcatcgacagtattattgtatctgtacattgcaatcttcattattgtgattggacatgaattttcacaaaagacgtataaaaatacattggtttcaggaatttcaaggttacaatttattttgtcgaaatacgtcatgatcttgttagacgtgtttgttatgacgttttgctattatttagctgccttaattacggggaaagttatgaatcgtttatggggtggtgaaatcggggaaatcagtcgtaatcttggtgaaatgacgctagtgattggctttttattagtgttatttttagtgttggcgtaatcctcttttgattttatcaaattcgattgtagtttcagcggtatttattgtattatggccgatactgattgccttagttgcaatgatgactacttggaaatggataaaatattttgattttatgggtgttgcccaacgcattgcgctcgggagtctcaagatagaccaagtaggaccgtacatcgtcactagtttggttgttttaatagttgcgatagttggatccgcgttgatagttaggcgaaaggaactgtaaaaaacgttaattaatagtatgtgctatttacaatcatgaaaactaaggattaagttttatgattgctttcaaaggagtattcttacgacagcaagcgaagttatgcaacgtgcaatgattcggattgattagtctgtttcggaagaatggttttaagggaaggtacaccagtctctaacatatcatagatgaaggtgttagtacttcgttgtgatggaagatgataatataataggatacagtgctaaaagctgatcttctgactgagacaattgaaatttagtatatggtgaatgaaaattatacggtagctaactaaatagattgatctttaaggaggtagtcttaagctatctctttttattgaaatatttagcaagtgtatactttatagtagaacaagaaatttggtctatacctctagttagtttaaaaatgcttattttgtaggaatggtgattgcaaaatagtctctcgttttagattattggcagagtattgaaatacctgttaaagcttgatatggtagccttaagaaggcggtaaagtatgataactgacaaatatgtcattacaaatcatctacaagaaattttagataaaaaaaaagataccattggaagattttgttaagtacgctactgcgtttggattatcacgtgctgtagtttataagattgcagcggatgtccattacagtatgaaggagactatttcgcataagttgggattactattggacgttccgcatgatgaattaattacatggagtctgaatatgaagatatatttggatgataatttgcgtggatttagcccaagcagcttgaaagtattaagtgatgagatgtctagtgctggagtagatttgcaatatcaagtatattctcgaaatggcgcaatgaatgttacaacaagatatgcacaaaatcgtcgtatgtatttaaacggtaattttaggatagatacaaatggtttgccagaattgtggttgataagctttgatgttatcaacaatcgaattgatacaacaccaacatagcttaggagttttcaatatcagctattaagaagagttgttaattttgccgaaaaagttggaatctacaggattaactactttgtaactcgtactgatagtggtcaacataaaaatatgtgtgtgtcagcggaggaaactatgcaaacttgtaaagaacttggatttaagaaattcaccagatgtggttcagatagctcccaactacacactttttgtaaaaacacttttaagttattgaagaaacagcagtactcagtgaattatgtaagtatgaataattaataacgtcagcagattttaatcgaattaagtcagatgataagaagcttatatcgataatgaactacaagtaagttagggagtttttgttaggctagcaatgcattatttagtcggtgtaaatcgtttagcattattgattatcttgcaatccggattacagactgatgaatatatcgtacttaaatatgaaaatttgaatttcttgcacaaaacgattcgagttgatggggcttgggatagttatcattcaatgacaaaagaggccaagactcaaaatgccaaacagacactatcaattacagaaaaagctagagattgggtccaaatttagcatgcctactttaacgattgctgataagaatgtcttgttgacttgtatttcatgttatcttgccatactagcatggcaagataacgtgtggacttgctaaacggatcaaatggtggttgaaaattaactgagtgaaagaatgatcatctggctaaagtccattctttttgctataaaagcatatgttcgttatgaaagatagtttgatcagtattctgattcgaaatacaattgtgaaccgctagacttttgggtgtatcgtgattgctagcttattcaacgcacaggttaagtggctttgtaataaacgtgtaggttctgcgccggatggtatcgaagaatcgacggttgtgactaaagatgtggacaaggcgatccttgccactggtttgttatccacaaaatatgaagtagcaacggtccggttcgctgattatatcgatcaatgtaacgctgaaaagcaacagaaaaaactattttggttactaaatgatggtggtaagaaggctcattcattggtgttgagagatgcgccgtgggagttcggtccggtgactactattgatgaagatacaactaaaacagagaagtcccctgtaaaatcagaactgaaagtggttgctgatgatgaaaagatgagggtgtttaagaatgagtaggggttatcgaaatcgacttaaaggacgcaaatataaagcagaggtcagtgttggatctggatctacgcgtaaaagaaagactaagacctttaataatatgactgaagccagaatctggattcaccaaatggaaattatggctgatcgtggaactgactttgaaaaatcacgttggctctttattgattattattggcagtgggtacaattgtataagaaaccagttgtttcagccaatactatgcacacttactggaccagttatcaacatttttcacaaggcttaggtgatgttcggctggaggatttgactcgtaatcgaattcaaaagtacttaaatggtttggacttaagtcatgaaagtattcggaaggatctcatgcaactacgaagctgcttgcatgatgcggttagtgacggtgtgctgacccataatccgagcagcgggcactttaagaattgtggctgatcctagccgtacgaaaggtgctgaatagaagtttatgtccattcatgactttaaacgggtccgcaactttttgctaagctatcattacagaattaacgacgttgaccggttagctttgttgatcattccgcaatcgggtttacgggttggagagtgcttggcactaaaatatgaagatatcgattgcttgcataataccatcacagtagatgagtcatgggatagtaagcataatattttaaaagaaccgaagaccaaacatgctagaaggaccattcctttaccaaagcaagtggtgcatattttggagcagtggatgagttatcagcggcgttacttgtttagagagggtgttgctaatccggaccagttcatactcatgaataaacatgggcgtttaccaagggctagtagcatcaatgctgcgtatcatcaaattcaaatcaagttaggcatggaacctaagtttttaagtacgcatacgtttaggcataccttggcaagtctgatggtagcagatgaaaacatctcgatggtgtacgtttcaaagtatttaggacacgcaagcgtgatgattactgagaagtactatattggcttactacccgaacaagtggaagttgaagctgggaaagcattgaagctgggaaagcattgaaggtgattgaaggatgaataatgaagataggccagcaatggtcgctgacctatcttttttgagcttttgagtctctttagctatacttagaaatacacgaatattattattgattaatacaaatttgtgtgtgctttataggaggaaaaatgaatttagattttaaagcagatgtacatttcagaaagaaacgagtcctaaaagaatttggatatttttaaggattactgctattggatgttttaacttaatacttttgctgttgtttaggttgttagatatgatttttgatatttcctttgaaacattggggaatttttgcctacttttggtatttctattactatgcttgtttcatactggaagaagaatgggcagttacgtaaaatagtttctaaatatttttttatagcagacggcgaaaacgtgcgtttgttatttcttctgcattcttaatgtatgcatcactagaaactctagcaggccttttgcgaagacctgatcaactatattccgatatagtcggtttgtccgcggcggtagttattctactttctataataatgtatacagccatacagcgagctgttagagttgtgctatgggctttatttccatatcttgagcgtgacgaaacaattactaatgttaaagagactagaataacaggagcaaatagtcaatatctatcgcatggtgaaatttactcatatatagtgttaaatattgttttcatgtttttagtcttgtattagtcatttacatatgtggctatataactttagcttttccagttactcataattttttatgtgcaagtggccgcatacattaaattgtctgccaataaagattttgatttgatggacttgattcaaattgtagcagctttcacaacatatcagggcttctttgatttatttagaaataaattatgcagaaagattaatgataagctatgatgaattttcgttgatggagtttgaatagtgttatccggcaatttaggaaagatttagtcctagcaggtatttttttaagttttagatactcaaatattattcagaaacgccgctaacataagattttatcagatgaagttgacataaagtggacactacgatatttttagaaaacacttaggagtattgatgtaccagtgcttacaggcagcgtccgcctcgcaactctgggaagaccaaatcgcacctaagttattagatggcaagaatgtgatcatcgcagtccacggtaactcattacgtgccttaagcaagtacattgaaaaaaacagtgatgatgatatcatgaatcttgaaatggctactggtgaaccagttgtctatgactttgataaaaagttatgtggtggtcaacggatgtaactaatgtaaaggtgggttaagaaacaaggtatcgattaatgactaagccccgaagccgcttacgttgactgaaaagataagtgaaatcagtgtagcaacagatagcttaaaaaatcaaagtgcctatgaggtctattcggttgttaaagtaaataaatctgaaatcaagaatttgcgttatgaccttcggggtacggtctattatattattgatagtaagacgtattttgaatacttctatgataaaattcatggtgtgaataataattaaaaagccagtgccagccagagattttcatctttggattagcgctgatttttttaactcgatcatctgattgtacctaatgtcagccactctttttctgtaaaaatagttctgataacatgccgtaaaggcggtaccaagaataaagatggcccaaaatatatcggtagtggattcaaatccatgactgtaatgcatcaggacaggaataaagagaagtaaagaaatccagaatctaaagctacgataaaaatttttttgaaacttaaatttcatttttattgcctccaaaatgtttgatcacatgctatctaaaatgttttaccatacactaatgctgatggaaatattagtccaatcattaatgtttaaagagatggttaacgaacgaatcttcacagtgacagttagttgttaaagatttcaaacagcaaaataaatttttgttgaagttaagtcgcctttcttgtgcttctacgcttaatatttattagtgcttctggatgatttgtatcataatttctattatataaagtgagtcccctgagttggagtaaatccagactcaggggttttactatgctttcagcctaactgatagttacgtggatgctggcaataagccggcattcaaaacttcaaaataagattaaaaaagagagaattggagttacagttaaatatgagtgtaaaagcagcagaagtaacacaacgtgaaatgatttgaattattgttttgttccggaagtaaggatttaaagttaattaccttagtttccagcacgtcgttgatgagggggcaacatatttcgttgtcatgggtgacgagaacaacggtaatcaagggttattcaaggccaacttgttgactggcgaagtggcgtttaggtatatgttggacgaggactatgtggtaagtaaataggtttcaagttaaaagaggtaatccaatacttaggattgtctcttttttgaaataattttaagtccagcatttcaggatgctactttggtggaatgaaaggtgacttacacagggcagaatgtccatcttggaaccatttgaacagagattggcattctatagccttatcgttagtgctttggcagcgcaacctgttgaatgcctaatgtggcagttctcaggcctagttgcgtaacccttagttgcgtgaatttgcctcttcttttgcggaatatctggctttaattgcttgtaagtaattggaagatgattgaaattaagagtaaaggattagaaccagtttggaggagattcatatgttgactttgagaaacgttaatacgtttattcaacgtaagcagattattaaacaagctacctttacccttaatccgggagacattgtgggactggtcggtccaaacggggctggtaagaccacaattatgaagactatcctaggtctcactaagtttgatggtgtcattttggttgatcacgttccggttacagaggccaatcatgctgcgcttactaatgttggcgcattaattgaacatcccgctatttatccctttttaacgggacgacagaacatgacactctattcacgggatcctcaagacctagaatatttagtgaatctactgaagatgtctgggtacattgacaccctagcaaaagagtacctcattaggaatgaagcagaagttaggtattgcaatcgctttgttaaaccggcccaaattagttatcttggatgaaccaatgaatggactagatgttgaggccacaattgatattcggcgaattattaaacaatatgccgaacaaggaacggctttccttatttcgagtcacgttttgagtgaattacagaagatcatgacgcgaattgtcctgattgataacgggcgcattatcttgaaccaagatagccgaacatttaatcatcaaggtctcaaaaattatacattacggactgaagcggatgcacaggtagctgaattactgcaaacagatcacattccttttcaaaggaaagaagaacactttttagtatccaagacagtaatctttgccgttcaagatattctagcagtacatcagatccacttcaaagagctgacgccagagacaatcagttttgagcacttaattgttcagattctggaaaggcaacgaggagatgaagacaatgcagactaatatcatgatggaattatataaattctggcatcaaaaaccccatactacggtgccttggcactcctgggtttaatgagctacagcgcaatgactactaaggttagtgctttgcagctggtctttgagtttggtgctgttcagtggattgtcatcatcctgattgctgtaggatcagcttttttgcgatggagtatcaaaatcatacgatgctcctactcgtgtataagcgggttaaacgacgcgtaatttatggtactaaattaggagttatacttttgtatggtgtgttgttgactgttatcgccatgctattcacttttgttctaaaattcctaacagtcggacaacgttatagctggttgatgactcaaattgatcatcgtgccatgataactgtgttgctgataaatgtgctcggtaccctgatttatgcgtgtttcatggtaaccttggctagcctattgtttatgttaatccgggtcaacacggtagtcatcggaaccggtcttgcagtcggctttctaggtgcgggcgtttctgtcggcttaatggaagcattgccatcatgggtcaatgtgcttagatggggaccgttaaatatgatttttatcacccagcagttggcaagcacgaccgatacgcgggtttcgcacttaacgaatccggccattattggcggaacattagcctatgctgtcctttttttctgtttgggttacttgttgtttaaacaccgttgtgtctgaaagaaggtctaagtaatgaaattcagcctttatcaggaatgttataaattggggcacaagaaaattgtctggattgcaccgctggttctgttagtattgatggtaatcaccgggtacagtattgggtataatcaaagtcggcttttaatggcaacttgctatgatgctcctgattggataatgttaattatagtagtcgttggggccacgacttttcaatggaattccagaaaaccaaagctatcttaacgttgctgtataaagcacctaatcaggttaatgtttatttagcgaagtatctagtgatgttggggtacgtgttattgctccatggcatagccattatttttactctgggattgtggggcctaccactaaattcccgggtaccttggtcaacgatttatttatatcatcagccattgtgggcgaatatgctgacaacggctgtcgtcaatgtactgacaacgctgtttattgtgagtctagtatttttactgtcgtgtttaattaacagtactgccgtagttactagtgtcagtctcttaatggtctttatgggacaattcatttcatcgagctttttaaatgtgaatcgttgggcatcagtactccgttggaatccattcaacatgattaatttgacccgtcagtattataactatgcgacctatttcgataccagtcacttggaaaacttccagttgctcattggaacctttagttatacatggctttttgttagtctgggatatttgatctttcgaaagaagcgtttctaaatcatattataatggagggttttacttatgaataaatttcctgaacaattaaaaaagttacggaaagagaccaacacgactcaagatgacttggcaacgaaactctttgtgactcggcaagctatctccaagtgggagtctggtgattcaactccggatctcacgaatcttattaagctgaccgatatttttaacgttagtttagacacattagtttttggtgccgagaaaattactaaagttgatgctactgaatttacgtttgatcctaaacgcaatcgctatgtgcgtaaattaggtcgaatgaacttctgggactttcttgcggggtactggtggttagtgatatcactggtagttataatagggttcttctggtcagttagtaggtgatagtttttttactgctgataaagtagctgtccaccagccaaaatggcaaagtcgtgttaagtgacatcattgcattaaataggccgagcaagaataacgtgataatgtgttaaattaagcattcaatcaagtgactcagcctaacgtctaaaagtaaacaagaaatgatcaatccatttgaggttggaatttactacttcaattacgttgatcgaacagtacaaagaaaaggttccgctgtgattgaatactgcgatgaatccatttgaaaagtaactaaaaagtaggctatttcatctgttaatttaaaagaaactagtacaattaaccgatattgctcttgaaacacactgccgttaatggtagaacgtccttggtgagataagccatcaaaaaaccagcaaataccaatgtccctgattattcagaacattagtatttgctggtttttaaattagatgaataacaaaattagttaatcaacatattgcgcgtagtcgatccctagtcgcttggcgattccggtaacttctgcgagtgtcttgtcatcaatctcgatgatgccgttagctgaccggtcttgatacgcggcagcttccttatcgccggcaacgatgactggtttgccgggaacggatggtaggtcgcgaatggcttgcaagtaagctgaaaacttagcaataatggcatccttatcaccaaagattgaagggtcgatggcgacaaagctctgacaagggcccacggaaaggtcgtccggagtaatttcgttggaggtgttgcccattgaaaggattgctgtgaaaacctcgacgatgacaccgagaccgaaccctttgtggctaccggtgtcttcggtaacgccacctaatggagctaaaccaacattggaatctaaatcacggagggcatccaagtcttttgtatcgttatggctattaacgggcgtttcgccatccttagcgacccataatgcgggcatatctttacctaatttacgataaacttcaattttaccttgtggcaccgtcgttgtggccgcgtcgaagataaatgtgtttcgggttggctggcatggcaaaggcaattgggttggtgccgaccaatgctttggtagcatgagtgggtaacatcgctgaacgtgaattgcacgacgacaggccaatcagaccttcttcggcagccatgttggcatagtaacctgcaataccatagtgaccggagttacgagtcgtaacgataccgataccgtgttgttttgctttttcaatggctaggcgcatgctatagataccgttcaattgacccaagccaaagtgcgcgtcaacgaccgcactaacatcggtttctttaacaacttctggctgattatgtacgcgaatcttgccgttacgaatgaagtcgtcatacatgatcattcgctggacgccatgggattcaatgccaatcaagtcggtgtagatcaacatgtgggcgacttcttggctttctttttcggtaaagccgtaacctttgtaaatattgtaaatcagttgttcaatttttttgctattgtatgcgttttaccattacattcaccacgttatttgaaatagacttaagtgacagccctgtatattataatatgataataataagaactttgaatgtcaattaaattttaataattcgttaatcttacactaattaaaagtgtcatcatataacaggtcaacctgagtcttcaaagcgcatgaaattgaggtcagactaactcaaagctaatgccgggtcatatggcacggaccaatcataaattaggtataactaaaggggtcatcaataaagtgtgccgttaactgatggcctgtttagggtggccctcattagtagctggtgatgaattggacgaaataaattgcggctgcgacgttggctgatgctagcgctgagaccgcgaaattgcggtttaggtattgctggtcaatatgcagactagaatggcaaggtgaattattggcgaatggttgcatttgttgtacgcgtgcttgtggataagttaaaggaattagatgacaaaataggtaattagttgggtctaatgagtgtaaatgttaataacatgacttgtttgtgggtaagtgcatgagtatctggggataagtaaggaaaatgaggataattgtggcgaacccagccatccacagtgcataacttttatgatgtagaagttatcaacagatttattagatatgatgtgaaattaatagatggggattacgtggttagtaataactttttgtaatctgattcaatgaaattctttagtttaggcactggctcaattagaattgttgcgtctatattgatttgaaattctgatatatcaatgattttgagcacctatcaaataaattgttagctatttagctcataaaatgggtaaataagtgtagtcggagggggaagaataaatgggagattcaattggacaacgtattaaagcaaagcgattagaattgaagttaacgcaaaatcaagttgcggaaaaattatttgttacacagcagactgttgcgtaggtgggaaaatggaaagcatacattaccagtaaaagctgttcaggatttgagtgaactatttgatgtaccaacagcttatttttttggtgaagatcaaattattatgcgtcgatttaatttttttgcatttgttggtagtgtttttgttaactttatcttattttggctaattgcgattgtattattaacagttttattaacagtgtggggtatgctaggtgccggtttggctgcaccagttgtgattatttggcagttcatcactgctgctcatatttttgacattggtcgtttgatgattagttgtggtatgttgctcatgtcgttggttgttattccaattgcttggaaaattacatgttatatcggttgcattttaaaagcctattatcggtataatgtaaattcaattgtgtatgaggtaataccaagggaggctaatgatgattatcgcaaataagattagcaagcaaattcaacttgcagatcatgatgttgtggagatattgcatgaaacaacgattcacgctaaaactggcgagtttttaagtgttattggtccttctggctcaggaaaaacgactttattgaactgtctatcaggattagtaaaaccaacctctggtgaggtttacattgatggacagtgtatccaaagcttatctgcacaaaaattggcgcaattacggcgcacaacgattagtacgatttttcaatcgtataatttattgccagcgttaaatgttttagacaacgtgatactacccttacgtttgaaccatcaacgaataagcaaagttaacgttgagacgttattaggtgatttaaattttaaggctagtttaagtcagtttcctagccaattatcaggtggagaacagcaaaaggttgcgattgctagaaccctagttatgcatgccaaaattatctttgcagatgaaccaacaggtgctctagactcaatgtccagggaggtaatatttcaacaattacgagagttgtggctaataatggtgtctgcatcatcatggtaactcatgatattgaacaggcagcccgtactgatcgtgcattaatcctaagcgatggtcacattgtttctgaggtcgaacgcccgtcagttgatcaactctttactcaaatggatagtatacgggggtaatgactattgtgtcattaagtattcatcaatttcaatattcttggaagtcttggatgacgggaaattttatttttattatttctggctggcttattggcttttgcttaactggtatcgatacgttgagccgtgtaacgttttcttcacacattgatccattaccattgtttatcatgccaatggtttttggtggaataacactattatttgttttaggtgaagttattcgactgattatgcgggagttggctaatgaataccagttatgggtggttttaggtgctaatcagcatcaattggcacttttaatcgctgtgcagatggggttgacagctttctttaagtagttgggttggttatagtttatcaatgctaagtataaagccgctatacggattattgcaattttacattggccgcacatggttgccgaacgtggtctttagaccatctgtcaaggttggcctgatgactagtttaattgtagcgggggttgcagttttatctggtctaattaacacataccgattattgcgacaacaccatagacgaattttcaacatgctcttattcgctatatcgctagtgggattgagcatagcgaattaccaagtgttagtgaccaatacacaagaagatagtggaggtgttttccttgtactattattttggctaattctagtccagactcaaattggcagacaattactgatgtggctttctggacggataacgaagttaacaccatctggactattcaaattagcaagttgccaagtgatgattaatgccaatgttaatgtgccaatactagcattgcaatccctcagttatgggttgtaatagtgttactttacggacttggtgggactggtggtcaagatattaagaatgtcattgtttcgtttattgtttatgtaggggcaccgggactactagttattgctaatataatttctgttgcgatgttaagcggacgccaacaagagcaaaacttccaacaattagagcaattaggattcagtgctaggatgctgttgcgggaacgtagcttggagtgctgttttcaaattgtaccgctgttaataacggcgatgattacgaatcttactttgtatggtgcattgctgatgcttgcatggcatacgcaagttaggatacaaatcagtttaatgtcagcctttgggctaccgatgggtgtttcaatgctgacatgggtaacgttgacgatggttgcatggaaagaagtttttgctcacttggagagggctgaaacgggtagacaataatttgctgatttattttcaacagctatatggcaaccttggcgtagtagtcgtacctgtaaagctacccatttacgctcgccacggtcaaacaggcccatcttgattttgaacagggtggtaatcaaggtaaacgggtaattgtctttgaccaggaaacgaccaatgtttagctggttttatcgtgagcggacgcgcctacccgagcagttacccagataagacactagaagtgggcaatgacacgaatcagcgtgcagccgcgcactaatctgttctaaactagtattagtaaagaaataaaatagctatctagacaaatacggtatcatgaacgacggtggccggacaatctttagtataatagtggttatcagttaacgtcgtacgattgattaattatgaacagggatagtaaatattatgaatgaatcggtatcggatgaaaacttttggattgtccatttgccagtgttcaaaaagtcgttcgcggaaaatggagcatggttattctgtatttccttagtcagcgggtcttgcgctttggtgaactcaatccccgcaaggtttatccaccggtgtcaccaaaggttgaatattcactcaccccattaggagagaagttcttgcctgttttgaaggctttggagaactttgcggtagactatcaggattaccaagcttaattaagtgaaatcggttaagaacgagcatgctccggtttattcacggcactaattgtcgtcatgaaaattaaaaaacgagatccagcgacgtcttcatacgtgcttggatctcgtttttaggtagaactaagtgactatcgagcccagagttgggtcgaatggcgatgtcacttggccttgaaccgcataactaaaatgataatattgcttttaaattctgaaagctaatgaacaactcttctttgaaacttttattgggaatattgttttatttaatacgcatgatttatctatccaagaaggtgtctgcattatgcggcagaatttggcgcgagtgttgacgttgttttaactgacaagattagtttttggaaaaacttagccgaacggattaccatatttttgacagtattggtaaaatcctaagcggtatagatcgatagttcgggttagttcttcactagattgaaaatgaattagttgtaaaacggcggcagtaaatgccagtgccgctgtgccgttagctgtgactagattcttgtcgctaatgacttgctgttcatgaaagtcggctgagttttgatagttaggataattgtgccacatcgccagtgaattgccggtatgctgataaccagttaaaaaaccgttttgggctaagtaatctaccgcaccacagattgcgccaactggttttgaggcattgaggtgttgctgaactagtgaatataataatgaattattgatattccaagagttaccaccaattaggattaataagtcaatagttggtaaacaatccagttgatagtcaactttagtggtgaagccaccaattgacgtaaccaatggtgttgttgaagtcgttttttaacttgccagccagccagtgctttgatttaattgactagctagataagaagcttcccaatctgcatattgatctagcattagaaataatgcagttttcatgttgacctccagaggaaaatatattttcagaaccgaatatgttatccttaattataggaacgtacgttctaaaaagcaagtgcatgattaaatgttggagggcagtaaatgagcaaacaatccgtaattcttgagttaattagaacacatatttgctatacaccacgggtctttcaacgtattaataagaaattagccgttaatttaagcgaagttgaaattaaagatttagtcaatcatattctgatacaaccagatgaaatcaaaaggtgtgggaaaaattattatatccgaagtcgtaaagcgcgggtagaactaacagtcaatgctggtaattatcgcttaattacagccagtaaatacacagaagtcgacggcttttaatcaataaaacagctaaaagtgtaaataaaaatattagtgaatccgtgtggtggttgagtattttggcaatgagaaatgggttttacttggatgaagcagtgaagtgcttcttacggaataaagcggaatacttaaaaagttaattaatgttagttgagaataattacaggagtgtagcacactttaaaagcaataaatcccccatcaggctagtatggaaatctagctgatggggaatttattgtgtgtatatatttggacgtgatttaattacgagccttcaccgatttgacggattaaacagcttataaactagtattaattgataactagtttaaattaagcgttgtgtcaaatgtcttataagcgttatcgtcgtcataatcgtcagtatcataactagcatcccattttaggcgaatactagtgatgtctttaacgctggataattttgataaaacaaagtatacgttaccgtcagaatcggtaccactgtttaaatcaccgtcaaaatcatcgctatccatgtcggcttcgacttgttgaccgtcgttcgtgctgagtttggcctgggtcggataggctgaaatatcttgcccggcatggatactcatgtgaacttttacgatgccgttaaaatctttcttgtcattaccgctaccgctagtataagtgccgtccgttttgtagaccgtgactttatcgattttaaatgtggatttcgcccagctactgtcggtaaatgaggtactgtaagctttttgatcggcgatatcgatgtcgtcatcgccaatcgtgatactgtcagagtctgaatctgattctgaatctgagtcagagtccgtgctatcactagattcttcactgtcgctatcgctgtaactgtcgtcagagttagttgtagctgacttggaagttgtcgttagagcagcgtccatggcagtatcacgggccgttatgttaatgagagcggcgtatcccaatgtcaataagactagcaggcaccaagtccaccattttatcgtgtgtccaaggttttggttggctagctaaacggtcgaaacgttttccagctggttcagagcgttggcataggaaaacaatgattaaaatggggccgacaagtggaagcagatagaaccataaataatgcgctgatcgattagagtcgtgaagtcgccgcgcactggctgtgaattgcatcactgaagtccaaaccatgagcgctgaaaaaatcaataacagcacggtttgtaaagcattaacgtgtaatgggctgaggataaacgctggataactgtatgctctgataccaagtacgatggttaaaactagggaaatcaggaccaaatctaagtaaagccaccaatattgaggccgcgtaatccgttgtgaccaagtaaaggtttgacgcattcctagctttagtgcggtccacatattgacatgttctggttgattaggtgtgttgtgctgctcggaagtaatggtgttctgatcttcagtggaagcgactttgtccttgagttgcgccacaaaaagggcaaaaggtcgcgttagtaggaatcgcttttccacagttaatacaatactttgtttctgacatcgatgttcctcctggagtacttatactaggcgaaatgttatgaatataagtagaattttattatatggccgagtgaatgattatggcagccgaaaacaagcatatcataactagttaaaaatattaacaaaatattaatactaaattcatattttgttcaataatagacttaaatagttatttatttgctttgttgaaagtggcaattctaagcttaagtaaaaagccgtgagctagaattgatcctcggattttgaaatactagatattggtcatggaaggaagaaaccatttacggcaattgtcattatacaaatgtcattatacaaattaattaggtgcagtagtttgtcgacatagtaatcgatgattagttatagactgaacacgataaaaccccagcgagcttttaacttggctggggtttaacaattaattgattctattcagtgctgcttggggaatgtcttttcgatcaactttttcccagttaatcacttgttggcgtttgtcattataaccgactttgagataagcgtgcatcttgagtgagcgtggtaggacgctatcaaaagtgagctctttcttaacaccattgtcgctgtatccaggttgtgagtaatggtagtagacatagggcttgccggaatcatctttcccggttttacgttcacctttagtcgtgatttgagtatagtatgtttttgttccgtaatttgagtggtaccagttgaaaccgagaccaactggtactaatacgataatagtgatgattagtcccaaaattcccgcctttttcattaataatccctccaaatgattaattgaaatctgatattaatcataagagatataagaaacggtggatagcagtttatgcaatgctaaacgaaaaacaagtaattaaatataatattaataatttaatgggattcaaagcctgattcttgcatttcatgataagttgtcatcttctgatgaagaaaatccaagttagcttgtgttgctaccattaggtcattaagttgtgtttcttgtttttgcagtaatatcaaacgttcagagattgtttgattaccgatatagcgcaattgcgcgtagcgttgcatgtttcgaatcgacatgcccgtttgttttaaacgcttcaaaaaattaacccagtcgatatctttagactggtattgacgatgattaccggcagttcgcgtgggacgaagcgcaggccgacttcttcataatagcgtaacgtatcgattgttaggtcagtttgtcgtgaaaattcaccaatttgcattaatttgaaaacctcctgaaataaagcttgatgtcgggtacacccgaggttgtaacctagaatcaatcaaatgaaggagctgattaaaatggaaaataagcaacggttaattaatggaaaagcccatgttacaacgggtggatgctgaagcagctgatcatgtaatggctagtttggatagggtggcaccggatgtggctaagctaattcttgaatttgcatttaatgatatttatacacgtcctggtttatcgttgcaacaacgcgaacttgttactattactagtttattaacgcaaggtgatacagcagaccagttacgtgttcatctcaacggatgcctcaacgttgggcttagtcgtactgaaattgtggaaacttgcattcattgtattccttacgttggttttccgaaggtattgaatgcgttgacggtggttaaagaggtttttgcgaaaatgggaaataacaactaagaatgatattaacaaaacgccagcaatgtcggattgtagggacattgttggtgtttttctattgagacttcttatattaaatgtcttatatgaaattctttttagcacaagtgatgaattctttaagggctgggttatggtttgttttttaaaaatgccactccataaatatagggagtatggtcgggataagttaaaggaacgactttgaagttgttagcgtcgttaacgctggctaggtcgaccataatggcaatgccgagtccgcctttaactaaagtatgacttaatagcaccgaatcagaatacaaataatttgcatcaggacaggcttgtttaatgaattgttgtagtttaaattgtcgtggcggacaaatgtttgaattaaataagattattgtttcatgtttgagatcgctaattgaaacagcatggtgacttgctaatttattattagtgggaatgatacaagcaaattgtccagtaattaatgggataaattgaatatcggctgagttgataatactatccctgcattgggaaaataacatcacattgttggctcaaaagatgttgcttgagaacattgtgatcaaagttctctaaatatagacgggagctaggatacagcttattaaattctttaaattagttgaggaaagtgtttgatttcataataagtactagtataaccaatcaatagtgaggagaagtttttttcttcgaaagtacgggcgccttcgatagtcaagtctaactttagtaataatgattggatattatcatgaagaaattgaccacttttggtcaggaatacgttacgtttagtgcgattgaaaagtttaaagcctaactctacctcaagtttattgatagtgtgagtcactgctggttgtgttacatgtaagttcttggcagtttgtgaaaaacttaatgtttctgataaatttataaataattttaaatcctcaatattcattataaaacacctacttataagtatcctttattaatgataatactatttcatttcaacttgtacaaataacgtgatagtctgaacacgttgatgaaagcgctttacttagggaggataattatgagtaataaactgactgatggtgtatatgatgtagttgccaaggggatatgaaggtaatgatactaagcttaaggttactgtggctaatcataaaattgaacagattgttcctaaaaagagattgtacctaatagtcttgaagatgcagtctttactcagatccctcgacaaatcataaataatcagactttggacgttgatgcattaactggtgcgtcacattctagcaaaggcttattgaatgctgtcagtgaagtaattaagcgaggctggtggtattccggatgaatttaagagcggcaaacgtttgtccaagaatatctcgactgctacggctgagaaagatgaaaagtattcggattggctccgaaaaccagcacatattgataaaaggatggatacggatttcttaattattggggctggaatttctggactggcagccgctgtgcaagctggtgaggaaggtataaaaacaactgtcattgaaaagaatgggtttgttgcaggcaatggtggcggtgttgaaggaatcttcggtattaataccgctatgcaaaaggacgctggaattcacgctgaaaaggaagagattatagcgcgcgagcaagaactaggccaatatcgcgcggatgggtcattctgggttgatttagttaataattctgctgaaaatatagattggttattaaagcggggtgtacagttaacaaaagttgatgattaccatggaacatgtgccttcccgacattccattggttcaaaggggatttgcttctgaaggatacgtaccatatatgaagcaacgagctgatgaactaggcgttaacttcattttaaatgctagtgcaaagggaattatttatgatggcaagcgtgtagcgggtgcgtacgtggaaacgcccgatggtaatctggcaattaatgctaaagcaactttattagcaactggtggcgtgggacataatcccaagctaattgctaagcaaggatggcaaactgagaatttgcattattgttcgatgccaagtaacactggtgtgatggctatatgatggcaatggctgtgggagctaaagatatgctgacagaatcggcggagtttatgatgaattatattcaagctttaccacataagggcgttcacttatatattgatccaattaacggatttatggcattaccttctggaggaccggttgtctttgttaatcaggatggtgtgcggctagttaatgagaatgtcaagaaagacaatttgttatatcaaaggatggcgattaagtctactaaggtcacctatgaagtctttaatcagaaggtgtacgattcaattactaaaggtgtcgatggggcagatcagattctggccgatgcagttcaacataatgaaggcaattcgttatataaagcaagtacttttgccgagcttgctaaatcggtgggattaccagtgaagacttttgttaagacaatcaaacgttataatcagtatgcacttaatggtaaggatgaagaattcaataaagacccggagatgttagtggcgctggatgaaggaccatactatattgctcgcttggatccgtcgaatctgattggtattggtggagttgcgtctaatcgtaaatttgaagtcatcaatgataatttcgatgctgttcctggtctatatgcttctgggatggatagcacaatgcaatatcgaagtgtatataccattactttaggcggatcggcatgtgctcataatgttaattctggtcggcatgctgccataaatgcaaaaaagtatatggactcatttaattgatagattatttgttgatttaagatgactattatcgtaaggctttaatatagacaggctgaaacactatccagttatttactaatatgaatgaatattagtaaataactggatagtgtttttggattgaaatcgctgttgaaaatgaattgtttgacttggaaaaatgtggattatagtcaattttatcagttgaatttgatcttgactataggcaagggtagcgtcaaaagaatcttgtgtaaatgaaatgccttcgtacatataatatgtatctaacttaaataaatgatgcttccaaggtgtcctggagtcctttgaaccctcggtggatccgcctcagagacttctcgttataaacattaaactgagaaaccagaaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggcttttgggggaaatgccgattcaagccttcatccaaaccaactaacccatcggccacaaacaacagcacatctttaacgccccgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaattgaatgaccgttgtttctaaattatcactgtgccgaccgtaggctggcaaggtatgattttcaaaccggccattgcgatctcgaggaatggttttaagttaagttggccgtacttcgtatcaaacgagcgctcataactgccgttgcggttattaccagtgttaattccagcgtatgagtagcgttcgtaacccaaaaaccccgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctctaggcaagtaccgtgttgttttgctatgattaaacacgcttttatcaatgatgttaactgataaattaggataaggtgttggctcataatattgtagttagttagtaatactttcaatgtttcaaactaagtatttaagctaagttagcttgtgctttttaaagtgccgttagttccagaactaaattggtttccagtataatacgctagtagatattatttaacggttatttaatatttgtacttcaatctgaatagggcagtttatgctaaatcgatataggaaaaatcattatggtaatgcaaggggaataatgatgaagacagatatcattttacgggttgtgcttggcttgctgtttacttgcttaggctgttttcaaatttttgctgtgagacggtattttcgccagttaaaactgcacggaaacgctgaaacgtccgcttttgcaccgctggctttgtggagcgcctttgtaattggcttgatttttattttcgttggcatagcttcgggcttggggttgatttaactaatatttgttgggattagtaaaaacaccataaacaaagtgcactgcggataatcgtagtgcactttgtttatgatgttttgaattaaaaatatgatttgatggttacgataatattatttttttattcatcaatttccggcgccgacccaagctctgcctgaatcatccagattttcttttcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaactttaaaaagttgggtccacgcatgtaccaatgcgtctgatggataatcattgacatctggctcaaatcggcaacgagttgatttaatactgctttggttttcgtatatttcattagattgatctcctttcgatatggttattattataacttagtggtagcttaatctgaaacgttatacactggcaaattaagttatttatagcccgtagaattaagtcgttttgaaaagatgggggcgttatatggtggtaattagtgctaacaaaaacgaccaccgtatgggtggccgtttgggtatcttaatcagtgtcgaattagacttattcccgtttcttgaacttagctgccagtcctagccaacctaatccagtaaataaagcggccaagataccacccagtgttgcgccgtgttcagattgttcactggtttgcggtaattgacccgaattgtgcgtagcaactgttgctggtgcttgctgttttcctggttgagccagggcactgactggtgcaatcggtgttggctgtggactagtcgttggcgacgattgtgaagtcgtagtgccttgtgacacgggcgcttttgccagcaatgaactccctggctgtggtgccgggtttggctgcggcaccgggtttggtttcgtggtgccgggtttggttgtggtgccgggtttggttgtggtgccgggctcggttgtggtgccgggtttggttgtggtgccgggtttggttgtggtgccgggctcggttgaggtgtagggctcggttgcggcgttggttcgggcacaggttctggttccggacccggcgtcggttgttcaggcccactcggctccggcgtgtaagtgtaaacgacgtgctgggcggtggtgccaaaggtcccgatcgttggaccgacaactttgttgaagacgtagcctggaattgacaactgttcagtttgataattttgaccaaagtcaccacttaaaacaatatccgcgtgaagtggctttccatccgtatcttgataactaacggtgacgggcagtactgcttgtttttcatagacgtaaaggacatgctgcggttccttggtaaagctaccggtcgcgttagttggtgtcttgatgagttgatagcctggaatctctagcgctttagtctcatacgctgcgccgatttcaccagtgtgggtgatatcaggttgtaaggttttaccatcttcgtcttgataactggcagtcaccggctgtggaatctgcttggtatagatgtaggtgacttgttgcggttccttggtaaaggtaccagttgcgttgccgatagtcttaactaagtcgtagtctggaatctctagcgccttagtctcatacgctgcgccaatttcaccagtgtgggtgatatcaggttgtaaggctttgccatcttcgtcttgatagctggcagtcaccggctgtgggacttgttttgtataaatgtagataacgtgctgcggttcagctgtaaacgtgccggccgcgttgtcaggtgtttttgtgagatcgtagcccgcgatttcgagcggcttggtcgtgtatggatcaccagccaaaccgttgcaagtcgtgtctggctgcgtggtctttccttgttcatcctgatagctgaccgtcacagcggggctccagctgttttatcataaacgtaagtgaccgcttgcggttccgcactgaaagtaccttgtggggcgccttgggtctcgacgtgggtgtagttcgtaatatcagccggggtgctttgataatcttcaccaacgaggccggtcaattcttccgaatcgcgcagagcggcaccgttacgatcgatatggtgaatggttactggggccgctttggctgctaatacatagggctgaaagacatggaacaccggtgaactgccatctgagccttgagcaaccaaataaaagtttttatcatttgggacaacgttgatgctgacgccgttagtgacgaactgaccgttggcatcaccagtgaagcctggaatctgtggtactaactgattgaatgtcaacccaccttgaccgtcgggtaccacgttactcaggtcaccattcacggcttttcccgcgccgttgaagtagaaccggtagtagaattggccgttaggagttagtttgaactggtttcaaaatggcggcttgcgatttaaggacagcttgctgcccgtttggtaaatagaagcggttctttaaggttgcactggtcgtgtcttgatcgacataaacgagtggttctagaattgtctgcccaagataagtagttgtcttgaggttcggtaagtctttgaagactgacaaatcagcaatatggttgtaagcgacgtccaattcttgtaggtttgtcaaatgcgcaatcggcgataaatcactgacacggttatgctgaatattcagcacagttaatttggtcagaccggccaatggtgaaatgtcagtcacgtcgccgttataataaccgccaagtgcgttgagaccgttattgagccaaatggttttcaggttcgtcgcgtattgcagtccttccaaggagtatggtgtgtgaccatcaatataagtgttttctccatagaattgggttaataattgcatatcatctttagtaatatcgttaacacaagatttaaactgatggtcggggagcttcaacgcttgtaactcgcgtaaaacggctttttgaaggtgcttgttcggcatccaagtatcaatagattcagttggcgtcgtcgctgcggtcggcacgattgtaccaacactagtcgcgggcttttcagctgtcgttgccgctgaagcagcttctgcgctagcttgctcggcatattcggaataggtactggaagctaagctattaatagcactggtaatttgaaaagtagttgctgtcgaagtcgcagtgctagcgggaatggttgcatgcgaagtgtcaggtgtcgcggcgcttgcctcactagcggccgttttagcaccactagtgggcgcagacgaactgctcgaaatggcactcgtcattggatgaataacctccgagccgtcagatgtctggcttgtacttgtagtgcttgctgcggctgatttttctgagctagtctcactggaagtcgaaagcggcattgactcgggcagcactatcagttgtcatcacactagtaggagccgtgctgttggctgccgtactattagtgacacttggtgcagcggcactagccgtcttggcggttgtcatgctgccgactgaagttggtacgggcatacttgcagagctagcgaggggtcgttgaatgaattacattagaactgtcagtttgctggcttgtactcatagccttgttgggtgtactactttcagcactagttggactggaactagcattaggcgttgcagttgtgtctgttggatacttagtggtcgcagagctggccatggccgccgaagttgggatcaggttattggtgcttgctgcctcggtcacacttgaactaggttcggcggcgtgaccacttgtcgctgaagagctggccattgctgacatcaatgagccactagtagccgttgatttcacgggcattgctgcggtactagttgctacaggactactggttgtagtactgccagttgcgtctactaccagttgtcgatgttaaggtaacttgactgccggatagcgggttagtcggcgctgtttgctggacagtaggcgcagtggtgggtgctgttgtcgaatcagtggccgcaaaggcgtcttgattggtcaaaataatgctggccaaaatcgtggccgcaatcccagtaattaagtgccactttggtgggttattagtgataatttttcgcttgttcaaaataatcatactccttttgatgattgatttagtcataagcacactaaattagttaaagtgtagcaccattattttggcgggtctagccagtttggtggacgtcttgtcacttagttgtgaatggctggatgccggtgcttttcaaaatcatgaaacaaaccgttatttgacggtacttaacgccgatgttgagctgagttagaacggatggacattaagaagtgcacgcttttagcgctgaaatgcttgtttttttaaagtttggtggttcgcaaagctgcaagttggtaaacttgcctaagaatggcgctcaagccagagctaccgattaacttgcgaggttgcggtgaaattggtagtcactaaactgcccatcagcgtatcaatgtgaagacagcgtaaaacgacctttccggataaattctgggaaggtcgttataggtttataaataagaaattaatgactaacgattgactgctggtgcgtgtattgcgccgcgtgccgaccggaattgcgtccagagtagaaggcgtagccaacacaggttccaggcatgttaggaccatacgtatcaccagttagtccagcggcgtcgttgccagcagcatatagaccggtgatcggttgaccagcagtgtctaaaacttcattattagtggttactttgagaccgcccatggtacaaaaggcgccgacattgagttcaaagccgtaaaatggaccttgggcaaccttaatgagatattcaggattcttgccgaaatcatcgtcttggaccattatcacaatattggttgtaagtttgaatggagtgggtgacttgatcaacaggtaggtgcattttggtcgccagtgctttaatcgtatcggctttaaaaataaatggtttattggcggccatggctgcatcgatttcagcctggagtttcgtcattttttttcgccccgccgaacgtaaacacctaagcccatgaagttcccgtcctgagccattttgttgatcacaccttggtcgagaatgctgaatacttggttttgggtgtagagcgcgttgccggcgtatgagaagttataaacgacagcttcatcgacaaatcgttccccatgttcgtttagccagagcaacggttgctgaccggccgctgtttccatctgggaggccatgtacttaaaggaaggttcgctcggatctttgagataaccgccaaagagcatcgccattcccgtgccatattgttgtgcaccggcttgccacgctagccgaagaccgtcaccaggttcctttacctgaactaactggaattaagcggcgcgtgtcatagtgggtcagtttctgcatcatgtcgggattattgaggtaaccaccggtagcaagaatgactgcggccgtattgatgacttgggtctcattagtggcggcactttgaatcgttacaccggtaattgcaccgtcagtggcttgatgtagcgtggtggcggtcgtggaagtcagtagttcgacacccagcttttgtgcttgtggttgtaaagcgtcatgtaagacggcttggcccattcctttataaatatgccacgtggcttcgccggcacccattgcttgtacgccttcgtattcgacaccttgatctttaagccattgcaccgtgttggcgctatcgtccaagtaacgacgccagattcgagaatcagcgcgatatttagaatagtcgacttcttcttttaaaacgtcagtggcggaaacgttgatgttttgggccttttgtaagtatgagtcgaacggcaaagagaccctcagtgtaattgctgctaccgccagtatggcgtcctttttcgagtaataacacggacgcgccgtgttgtgcggcttctagggctgccgctgttcccgctgctccggtaccaacgacgacaatatcgtatgaatcatgttttgctaacgtcatgtcaattcctccaaactgatttgttatctaatgagcatttgacggctaaattcaccattactataatgaagtaaccgctatcacaccctcatcataacgggggtatggtggttagcaaacagacaatttggttcggcgggcgaatcaatcgtgcggatggagttgaaaaaatggatcttgaccggctacagacgttcttaaaagttgttcagtatggtagttttcagcaagtggctgcccgtgaataccgttcacagcggacggtatcaaagcaaatgacccagttagaaaatgaattgaaagtgacgttatttgaccgtggacagaacagaaatttcaattgactcctcaggggcggttattttgggcatctgctcaggatattgtgaacaactatacgacggccttgacggagttacgtcaatttaatgttcctactgatcaaatcttacgagtcggttatttctcagcctttgagcagcggctcctattaccggccttatacgatttaaagcaacagcattcggagctgcaactcgttgttcggcaagggagtaacgagcatctggcgcagcaagtagctgatggttcacttgatttagcactatcgattaattatggccgtcccgccgttactccagaatcacagttaaccgctgtcccaatttatcataatcaaatggtgattggggtgagccggctaaatccactgagtcgattgtcacaattgccaccgagtgcgttggcgactttgcccattttatattacagcccagaaagctcgacatttttattagaaagtttttggctagtgccccatttatccaaaactatgagcagattcggcgagtgccgagtgcagaacagatgcacttgttggttgcgttgaaccaagctttggcattctatcctgcggggttagtgccaactgagcatgatgagcaagtcgcgtatttgccgattacggatgctacgcaacaaggctacgacatcgtggcgttattaaaatcaaaccggtcccggccgttgatagccaaattggtacagcggttaaaggcgaacgcgaaatctgacgagtagaagattaacctcacagtgagaaagtactgatacggtgagcttgcttaagtaaaaggaccggctgagattgcaggcctgtaaaaattcagtgactccgttataataaaaccattgttctcaaactaatgaatttatacaggaaagtgggcccaacatgtttcaagatattcaaccacacgttttaaaaaatcagaatgatcagcagcgggcaccccggtcgggcgattatatcttaattggtcgtcaacaacaggtgcttttaatgaatggaaccttgcccaagtacgaagatatcgatgcggattacgcgtttagtcctgaccagtatcagtatttgctggctgtcgatcaggcggcctttttctgggtcgatgttgatgcggttgcgaatgataactataccgttggcactactcgagggttccgagacctaacaccggcctggttggctttcagtagtgcgacggctgcccatttggcttggtggtatgatacgaagcggttctgcgggcattgcggccaaccattacatccgggtgctacggaacggtcactggtgtgcgcagcgtgtggtcagacgatttatccgacgattatgcccgcaatcattgttggcgtgacgaatggtgataagattttgatgaccaagtttttatccggctacaatcatttttcactgatttcaggttataccgaaatcggtgagacctttgaagataccgttcgccgggaagtctttgaagaagtcgggccttgaagttcataatattcggtacttcggtagccaaccgtgggcgccgtcacactccttactggccggctattttgcggaccttaatgagaacgtggcaattgagctagagacggacgaactatcgaaagcccaatggttccagcgtgaccaaattcctcataatgatacgaacacgagcctgacatggacgatgattgaagcatttcggcatcatcaggagaagtagacttatgctacattataccgaaaattaaacggaagtttttaataagatagcgtactgagaattgaaagctaaattcttggtacgctattttgatgtgatggtcgagtctaaggcgactttcctataaataaccattatttaaaacgatggtagtgacgatacaagcagttatttagtgggctatgatatcatagcttgaagtcaattaatgatagtgtcataaagtgtggttactttacaagatgggctaaactgataataatcaatcattagttatattaattaaaaaagggtgaagcagaatggcactacttatttcgactggtgtgttagtggttgcggcaatggttagtattgtaattaaccgtcgttggctcccacgactatcggtcaactatgtgagcatgtttattggagcggggattgcggttatcccgttcttaaatggccttatcgaaaagttcaattcagatatttttattggactgattgtagcaccattattatattttgaaggccagaatacgcggctgaatttagttggtcgtcacgtacgagaaattgtgagtcttacagttggcatggtgattttatgtgcagtcatggctggactcggcactagcacgctagcgggtgttggactaccattagcctttatcttggctgctatcagtacaccaactgacgcaacggctactgagtcggtgacgatgggccgggtgctaccgcagcgtgaacagactagtttgaaattagaatcattgttttaatgatgcttcgggaatcattctgctaaacatggctattctgtggtatgttaacggttatattaattattcgcagaccttatgggatttcgtctatgcagctggtggagggattgcttttggtggccttgtaagcggcttaattgtttatattcgacaattaatgttgcgctctaaacttaattttattaataacacgtataataatggtactccgttaaaagtgatttatttaatgacaccatttgtgttgtactttggtgctgaagcacttggtgtttccggtatcattgctgttgtatttgcgggattagttcataatgctgaaggggagcggagtgcattagccaatcctcagctcgccagtgatatttatcaattaattggcctattgagcgatattttaaatagtgtggtctttattgtattgggaattatgttattgcggaccgcgttggatcattccgtctcttataatggatcactgatctggattgtaattggcgtgttattttatacgtggccaatctgttagcacgttatggttacgttcgacttattcatcatgtccctaatcgagaagcgtgggtatttgctttgggggcattcatggtgctgtgacgtttgcgttggcctttatcgttgcggaaactcaagttaaaacgactgatttcaatttagtcttgatgtctgaaagcttattgattattttgagcttattagtaccaacgattgtttttcgctggctattgccgaaaattaagactgatacggatggtgcggccaaaatggcggtgattagagaacagatgattgaagctggagttcatgatttgtggcaaatgccgatttcacaagaatttaaagctgcggtgacgtttgacctacgttcacagaatggacacacgacagttcgacagtttatttcggaatggggtcggatggtccaacatcctgaatatactgctgatgaaatgcgtgaactaatggttatttatcgacaagtcttatttcaaacggaacgcgattacttgcagcgacaatacgatgcgacacatgccattagcgaagacttgtttaaccgcttgtatcatgaaattacgatggctgagatggttgttctggaatatggtgtgaagtaagcgggataatccaagattggtgtggcaagtcgaaatattgattggtgatcgtctcaaatgtaaaggcaccccaatacttattcactgtgaataagtattggggtgcctttttaagactagaaacccgcaattaaatagttggtaataaatattaagttggctgtcagtgtttaaatcaataaggggaatttttgttgattgccagaacttgatggggatattgcaagcgggtgtgattagttgtttggaaagttcggcaatgccaccacttgattcatccgggactgatatggtgcatgatgtcaaatatggtcattaggatggcagtcaaaacaatgactcgccggcgagtgccataataaaacccagccaaaacgtgagttaattgttttgactgattaaattagatttattaaaaattaatgctgggttgtttaaacgtgaaaaccaacgtctgattggctgcattgcaagggctagtttcacccgattgattgaaacccagagatcaacggatggtctaacttgattaaaggcttaaaattgcattaaaaacactttgtggcagcttaatcgtatttttggacgcgcggcgtttattagcgctttgccgccgtagtagggccgcttttttggaagtactgtgttgttcgccgttcaccgctgcatttttacgcaatggtgggacatcgacgcgggcgataaccttaccttcaacacgtgcttggacgggtgtgggatatagttgccgtggaaccgtcgtcttcagattggcgaccaattgctgcgtcatgttgggggcgtcttcacgatggacgatgaaggtcaacgcatctacgggcgcatagttgatatcaacttcaactttgactagatcactgacttcattagccataaaggcggtgcttaaactcgcaaagccatgtgagactgattttagttctgagaaaaagtggtaggcgatttctgacaagggtatcttgagacttgcaacaatcaagtccccgctgtttgccaagtcgatcaaggtccctttatgctgttccgcaagctttaagacggcatttagattgtcagcaggcatcgtgatctcggctttcataaagggttcagtcacttctttaatgagactgaatgccggaaactgaacgggattattgacgatcatttgctgaccattggtgagtgtaacgtggtaagtcacattgggagccgttgttagcacgtcgaccccgtactcatcgtggagtcgttcacgaatgatttggaggtgaaaggtccctagaaatccgcaacggaagccaacgccaagcgcctcggatcgttcttcaacataggtaaatgacgggtcgttcaagttcaattttttttgaacggcttccttaagtgccgaatagtcattattcttaggatataagcccgcgaagaccattgatttggctggttggtagccggctagcggccactgcgtgggggtggcgacggacgtcagcgtatcaccaacacggacttttcgtggatctttaataccagtgaccacgtaaccgacgtcaccagcgcttagcgattcttggggtgcatttgaggcgcgaagacaccaatggccttgccgttaaaatcctgttgtccttgcattaagcacagtgcttgttgtgatttgagctgaccatcaatcagtcggacataggcaatgacaccttgatatgggtcatacaacgaatcaaagactaaagctttcagcggctggtgtaagtcgccttggggagctggcaaccgctgcttgatggcttccaagacggccggcacgccttgcccggttttagcggagatttgcaagacttgctcgggtgtgaaagctgagtcgaaggtcgttcaattgggccaacgcagcgtcaatatccgcagagggcagatcaactttattgagaactggtatcaaggttaattgacgttgtttggcaattcggtaattggcaatggtctgcgcttgaacgccctgagtggcgtctactaataggatggcaccctcggtagcagccaagcttttagccacttcgtaattgaaatcaacgtgaccaggggtgtcaattaagttatattcatattcttgaccatcatcggcctgatagtaattccgaactgtgcgtgctttgacagtcacaccatgagcctgttcaacggtcatatcgtctaataattgggcgtgttgttcacgcgcactgacggtctgggtcagcgccatgatttgatccgccaacgttgatttaccatgatcaatgtgggcgatgatggcgaagttacggatatgggattgtttcatttgtgcgaaaactccttcaaatattgggtcaagtagtaacgaatttgttgttgggcctccggtatgagtcgaatttcgaagtcgggataatcaacggataatttatgatgattaaagctggtcaaagccgccatattcatgagcccactgataatgccactttgaataatgaacaggtggctaaattgggactggtctaataagtggtctgtttggataacgagttgttgtcctaagcgttgactggcgcgatacagggcctcacgttgtgtgatggtttctgcatgttagctttgccttctaggattggcccacgaatggcattcaatcgaatcagaacgctatgttcttcaattaattggcgagtttgggtggtcatccacgcgataaagtcgtcagctgatagtggtggttgctgggctaagtcggtcgtgagttgggtaaagtattgttgatagtcttccaataaaatcgtcatgaacaagtcttctttggtcgtgaaatagcgaaaaaagtcccccttagagctaccgacggcttccgcaaattttgctgcatggtgatttcgggatagctcctatgggcaaataaattaatggcagccgtcatgatggcttgacgcttggctgctttttgactgggcgtatagatattagccatgtcggatcctcctaatttaaaaatgaccggtggttatctttgaaccagaatacgccaaaaataaccacgggtcaagattgaagtggtgagtgctgggctaagtcggtcttgagttgtgtaaagtaccgctgatagtcttccaataagagcgtcatgaacgagtcttctttggtcgtaaactaacaaaaggtcgttccttttaatatttaattattaaatatatggtattaattatagtttctattggaataagttcggagttaaagggagagcagagctgcattatttagtgggatttatcattacaactggcaatgattagataactaggcgggttgggtgattaaaagcgctatgtgtagtttgcggatattttggaaagtgataaatcaggccgaatattaatggtgtccatccggtttattcggtctaactgtcacgtaagccttctggattaacaggggtggataaatgcaataaatacgttaaaatttttaaccattataaaataataatgttataattatacggtaaacaggggaaacaatactgtctgttatctattgttgataataagggtatcagcgcgatattaaatttatttttataatcaaactgtggatgaaaggttaacggctgagccgttagtctctaataaagggcgataatgattaagaaacggtgcaaaaagacgccagtacggatcagaagtccaaaatagccacgcgttatattgtaactaccgtgcgggctaatcgttggcaaggccggttaccaccgactagtgagcaagtgtgccaatggttactagttgcattaggtgttctactactgggactgttattgattgctagttagggtaactataaatgtgagcgctatcaatgactgaagttaaaagattacgctgtcacatagaattgctgattaaaaggagatggtcgggtgcggcgaatatgtaaagtattaatggtaattatcagtattattttaggaagtagtgcgccattgaatatggcaataccaccgttattggcgctggccgcgccggacactagtagttcttcgacgataagtagcagcgcaattagcaaagttactgataccaatgtgatggccgtgagtgcggatgtgacgagtacaacagacacgtctgatacgagtagctctgacagtacgtcggcgactagtaccacgacgggtaatgataccactgagacggcagacacggcagtggaatctggaactgttgggacggtagcatggaccattgacgacgggggtgttaacgcttagtggtggtagctttgctgatttaactggtaaacgttcgccttggtatgattatgcttcatcgattacgaatataaagattacggatgatacaaattacggtcacaacggcttcgaattatggatacttgtttgctagcctcgctaacgtagcaacagtcacaggtttaaataagctttcgatgagtggtgtaactagtacccagtctatgttttatcgtgatagcaagttaacttcagtcgattttggacagaccgatttttcaacagtgactactatggaatcaatgtttgaagggtgtagcgtgttaactaaagtaaatactacgaactggaatgtcagtcatgtaaagagttttaagagaacattttacatgtgtgtaaaactcactatgcttgatgtgagtaactgggatgtaacacaagtaactaatttagacagtacattttctggctgttcttcactgcctgagttagatgtcagtcgctggaatactgctaatgtgacaacactagcgtctacattttatagttgttcttcagtaaagataataaacgcaagtggttgggatacggcacgagtaaccgaatatgactgctacttttatgaactgtactttggcaactgaacttaatgttagtggttgggatacagcgaaggtaactagcatgtctcgaatgtttttattgtgaaaatgtcatccaactagacgtttctggatggatcacttcccaagtaacttcactggggagtatgtttcaaaactgttctaaagtagtaacgctggatgttggtacttgggatactagtaaggttacggatatgtcatttttatttggaggctgcagttctttaacgactttaaatcttgaaaaatgggatactggttctgtaacaactctttattccaccttttataactgttctgggttgactagtttgctggttgatacttgggatactagtaaagttacaaattgtttttggacgtttggtggttgctcatcattaacaactctcaatcttcgtagctgggatcttcaatctgctaccgccagttacgggaatttttttaatggttcaaaaaaaattacagcatttgacactaggtcctaattttacgtttcataatgataagacgatgtacttgccggagccaagcaaacaactaccatacaatgggacgtggcaaaggaacaatgatgatccaacctatacgtcggcggaactaatgactaattatgatggcgcaaccatggcggggacctataactgggttaagacaagtggaacggtgcttgtcaaatacgtagacggcgatggtgttgaaattgcggatgaagagacgtcatccgggacatcgggtgatgcttaccaaacaacggccaaaacgattgatggttatacgcttcatgcaacgccaactaatgcaactggaacgtatgacgcttcgacgattacagtaacctatgtgtacgatggtaacttattcttcaattcgtcaccaacaatgctcgattttggcagtcatacaatatcgggaacaactgaaacttatgcgcctactctggataagacacttgcgggttcagaacaatgggaaaataagttcaacctggaatttgactgcagaactcgatagttcaggctttgtgggagcggacactggaaaaatgttgttggctacattatattaccagaccgatgatggaaaaatgaccttgtcacctggggtagccgtacaagtctactcacagacaacgactgatcataaaagtgttgatatttcggaacattggtccagcaacttaggattgctactagaagtcccaaatggggctgccatggctgacacataccaaggcacgatttcatggcgtttgaataataccgtggccaataattaattagtgattcatagttaaaaacacagcttagtttgaaaggaagcgtattgtaatgaagaaattcgttttgggattaatgatttctgcaggacttttgggagccacaacggttgtggctaatgctgatacgactggttcttcgaccggtgatgtaacatttactggggaacattgtcacaatgagtgttgacgctactcatttagctttcggtagcaacacgattagctccagtgatgccaccttagccacttcatcgacaccaaccgttacggtaagtgacttacgtgggaccagtgcaggctggaccttaacggttgctcaggggcaacaattcaatacagctcttaatgggactggttcatcgctgattaatgctgctttgacagttgcgggtactgagagtgattcggcagtgacaaatggcagtactacgttaacgccggggacaacttctgccgcgggtgcagctgggaccgtcgcttctgctaagaatgggactggtaacggggcatcaacggtgacatttagtgattctaagctggctgttcctgggaaaacgactaaattagctacggggtacacaaccacgttaacttggaatttaaacgacacaccaggtaactaatccgggtgaacaattagccgatgttggctacggccaatgtcgatacataaatctgagaaaaaggcggggttaaagtgcagaaacgattgcgattatctttgggaatgttattggcggttgtcgctagtctattaatgatgggacaagtagcctctgctgatcagggcgttggttttgaaatcacgccagtccagtctagcagtcaggtcgataagcgtctctcttactttgatttgaagttaaaaccgcgacaaacacaaaccgttgcggtcaaaattcataatacggctagtgagcccattacgatcaatataggtatcgctaagaccacgacaaatattaatggggttgtggaatacaaacatacgaataatcgcagtgcgaatttgccgtatgatattagcaaattagtgacaactgatgaaccacaagtcaagctggctaaggggcaagtcaagacggtcaagtttcaaattaagatgccggcccaaagttatcaaggcattttagcaggtgggataactttcctgaaaaaggccacggcaactgatatactaaaaaggccgtggcagtcaataatcaatacgcttatactgaagctgtaattttgcatggtagtaaagacctaacgaccaatcagctgacgatgaataagattacggtcaaacagctcaatgggcgcaatgctattaattttccgttagtcaatcatacagcggcttacttaaataaagtacaaactaacatcaagatttatcatcggggtggcagtcaagttgtctaccatcaaaagttagcgaacggccagatggcacctaattcaatctataaattgccattgcagacaggagaaaaagcgttagcagctggtaaatacacggccgtcgtgaaagtcacttccaagaagcaacactggcaatttaagcagaattttgtgattacaaagggccaggcggataccttgaataagacggcggtcttgaagcaagggcctaactggtggttatatatcgggattggcttattactgttattattgattatcctggtaaatttggtatattcggcgcaagcagaagaaaatcaggtcgcttgaagaacagttagctgaaaagaaccgtcaagatagtgaatcataatcaagacgcaagtgcaatttaatcgattagcacagattaacaattaacatgaatagtggatatcaagggcgtttttggaatgtaatattctgaagatgctcttttgaattgtttgatataaaacagaaattaacgaacattgaatgactaataaccacctggaaaataccggcatactattaaagtaatgttgcaaggattagatgttttgacgatatttataattaatgtataaatgttgttggagaatatggttctatgtttatctaaaatagttatagtatatatcatgactataggtgctgaattgaagttgagttctcagtaaagtgttgttatatcaaaactttggtggccgttaattattaggcctactgttagtaagaggtgtatactgattgataatatgagatatatatagggtattaatactgttataactaattgaaaatgtttcggggtagatagaatgcaaagacgacgcttacaacgagcacaattaacagaaaaacgaacttataaaatgtataaaaaggacgcctgtggttaattgcggggttgagtactttcactttgggtgctagtctgctaccgatgatggggcgggcagacacgactagtacgactgctgagcaacaggggacggggacagagacaactggcaaccaagttacattggctagtaagtcggttggtagtagttcgatggctaatgatggcgaagaaaaactaataacagtcaggtagagacgagtagtgaagctagtaatgttactgcatcgactgaagctaagtcaacggaatcaacgactcagactgtggttgattccaccgtgactagtacggctactgaaacaacacgtgcaaacggtgctactaatcagaccagcaaaatgtccatagtcgatacgacgatctaacaacaacacagaacagaatcaagcagtaggtggtacaacagacagtacggcaagtaccgcaactattgaggatcaagctaaggccgccaacagagcaaccactgatggcaagataaatacggctacagtagctacgaaaacaactacaactgccagttatgcaaccgcggatattagtacgaataccattcgcagtgcgcaaaagctagcacgagctactgtggccaccgttgcgacagtaaattcagcgactaagacgtatgatggtaagatagatacaccaaatcgctatacgattacgctaactgacggaactaaggcgccctcagattgggctgtaacgagtactgcgaatgtttatacggttactgacttaacggacgttgatacgtccaagtttggatcgagtgttggaacatacacattggcactctcaacggctggaattactaagctagctgaagctaatagtagcgcggatataacggctgctaacgtgggtgacaggaacactaacaatcaagcaagctccggtaccgactgcgataattaccattggttcagctagtattgactatggggatgctaaaccaagtacgtatacaattacggtgccgagtcagtatgcagttcccagcacctggacgttagctagttcggctactgatggaacgactaatacttatatgattgcaagttctagtggcgatgttatagttcccacagcaacccaatctggaacgtatcagcttgtgttgtcagatcaaggcttgacagctttacaacaggctaatcctaatgctgctattactgctgatacgattattgctggtagtttagttattgcggcacatgacattattacgatgggtgcgacgacaattgtcgttaataaaacgactagtacggttccggtgacggtcaatagtcgtactattgtggttccaacaggttggacaattcgttacgatgatattcagactgatgcgattgtgtagtgacgtccccgtttccgatacgacatattcggaagcggttaatactgctgtggttgataaatacaccattacattgactgatgatacgatagaaacattagctaaccttaacagcagtacgacttttaatagtacgacggttggtaagggcgtagtgcttgtcaaggctagtgccgcagttgccatctcacccgcaaactatgggcgcggctagtgccgaaactccggtaacagggctgacaatttcacatgcccgaacaaagggaattgatttagcatatggtcaggcgctgtatttgatcttgccgcttattaatatgaatccatcaggaatgactgtggctaatcttactgattatgttattattccatctggttttaaggttgctactaatagtgaaggagctattaacatagcgactgatccaagtagtgtgttaacgtctgctattgaagcaatgatgacgaaaaatgatgtgacctatcaggggttaaaggtgacccaactgacagactacaggggtcgccaaacatttaaaattcattttgataaaaccactgtttatgacggtggtgcatttgcaacgctaaaatatgcattattaccggtcattgctgttcaaaacactggggtgactagtggtttaattggtaatcaagtttcaagcccggattcggcggtggtttatgttactgatgattctaatgaaaataatggtagttattcgttgaatttgcaaaattatactaatattgacagtgtcgctgatgcattaggaattgcggatgctgtcacgattggtagtggtttcacaagttacctatatcattacacgctatcggccaaaacgattaccgatacttatagtttagtaggaaacgatggcacgtcattaggcgaagtaacttttacgggcgacagtggtaagacgtatgtaccgatgactaaattaccggtagcgtcaagaatcttgtgtaaatgaaatgccttcgtacatataatatgtatctaacttaaataaatgatgcttccaaggtgtcctggagtcctttgaaccctcggtggatccgcctcagagacttctcgttataaacattaaactgagaaaccagaaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttggggaaatgccgattcaagccttcatccaaaccacaaactaacccatcggccacaaacaacagcacatctttaacgccccgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaattgaatgaccgttgtttctaaattatcactgtgccgaccgtaggctggcaaggtatgattttcaaaccggccattgcgatctcgaggaatggttaagttaagttggccgtacttcgtatcaaactgagagcgagcgctcataactgccgttgcggttattaccagtgttaattccagcgtatgagtagcgttcgtaacccaaaaaccccgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctcaaattacccatgacaattacacaaaatggcgtgacgtattatttgaacactagtgcagtttcgttaactcagacatattctggtgatagtaattcaaattatacgctcacttaccagcgctacgtcacaacgacgactgatactgcggccaagataacgattgcaccagcttcaaaagtctatgataactaacgccacgactaatccaagtcgctatacggtgtacttgccgactgaatacacggccccaagtaattggactgctgatagcgcggtgacggctgtggatgggacgacggcgtaccaagtcagtatcgactaccttaataccactgcaatcgatcaaaacgtgggcacttacgccgtcacgctgaacagcgccgggatggcagccttagccgctgctaatccagacttcttgattgcaggcgatgtgaatgttggtgggaccctgacgattactcaacgtccagtgacgattaccttgccggatacgattctgtgggccaatggtcaggaacaaaatattacgccggtcattactggtgttgttgcggggcaaagtttggattacacgttaacgtcagggttaactgatccggacacgacaaccattacggccacgctgacgaatgccactgctaatagtaattataaattgacgaattcgcctagtggtcagttgaccggtgggcgccgtagcggttgtctatcagtatggataccgcgacaaagcggggacgctacacgtggtaacaacggctaatggaacggcgacgcacgggactgatgtttccgctaaggactatttgagctacaccacgagtgatacgactgctacgcatgccaaaactggttatacgttacaaccagaaagtactggctaccaagccgatggtactttagcggacattggtggtcaggtcgtgtacacctatttagcgaacacagaaaagattgcggtcgtttacgtcgatcaagataagaacaacgtgattttaaatcaggtccccctcagtgggagctttggtacacacacgaattatacgacggcgcgaggacattgcggcgtatgaaaaattaggctacgtgctagcttcggatgaggtcccagcgcagcttgagtttgatcaggatactgaacagacctactacgtatacctgaaacatggcaccatcacggcgacgggttgatcagccaggtaacgtggccgttagtgatttgatgaagaccagtcagcgaacgattcattacgtttatgctgacaacacacccacggacttagcggatgtgcttcaaacggtcacgtatacgcgcacggcaacggtggatgcagtggatagaacggtcctttcgtacagtaattggacgaccactgtgaatagctatccggccattgagtcgccgaacattactggttacacggcggatcaaacaaccatcgcggcggctgtacccgctagcatgggcgaggctacggaaacaatggtccgatacaccgctaatcctgaaacgatccgggttcaatttgtcgatggaactacggataaccaggtcttaggttatattgatttgaatgggaaatacggtgatgctgccgactatacggtcactgctgacattgcgaagtatgcaaaattaggctatgaaccagtcagctcggatttgcctgatcagctgatttcataatcagaatgcccaagtttatacggttacactagcgcatcgtcacgtgacggtcagcgttgattatccgggccaacctggtcaggccatcgatgctgattatccagccggtcctaaatatccggcgggcactggtcgtgattcgttgcaacaaacagtgactcggacgattacgtatcaatatgcgtcaggtgaatcagcggctgaaacggttaaccagtcggtcacgttcaatcgcacggcaactttcgacatggcaacgggtaagcagctgacttacggtgactggaccgtagcacctggtcagtcagcactattggctgcggtcacgtcaccaacgattacaggttatcaagccagcgttgcagaagtcgaagcaacgtcggtcactagtcacgataaatcgtgctcgattgcaatcacgtacacggccaaatcgcagaccgcaaccgttgcgtttgtggatgtaacgagtggtaaaacactacctacgatggtagtagtaactggtgcttatggcactacgaatagttattcgcccgtttcacaaattgctgcgtatgaacaactgggctatcgattagtttcgaataatgttccgacgactggtatcacctttgatcaaaatgacgtcattaagtcatacacggtcaagctagcgcatcaaatgacgacggtcacgccaactaagcctgggcaaccaggtcaaccagttgattccgctcatccagaagggcccaagtacccagctggtactgggcttaaagatttaacaactagtgttcagcgagtcattacctatgtttacaatgatggtcaaactgcggcgtcgaccgtcacgcaaacggtcagttttgagcgcaaggcgacctttgatcaggtgacaaaggtggtgacgtatacggattggcgtacacctgaatcagcgttgacgggggtatacgcagtcgttgaatcgccaataattgctggttacaccccgaacgcaacccgtgtggctggatgtaactgtcagcgccggagatacggattcgcgacaaacggttacttaccaagcaaatctggaaacggcgacggtgacttatgtcgatgtcacgacgggccaccgactgggcacaagcgtgacgttaaccggacgattcggcacgcaagcggattatcaaccaacgacaatgattgcgcagtatacccaagcaggctatgtcttgatggggagtgattatccggcaacgggtgttacttttaatcaggcgggcgtcgttcagaagtatacggtgtacttggctcataacaaaatcgtgattacggcaccagatcagctcaccaaaacgatcacgcaaacggttcactatcaggatcaggctgggcacacgcttcaagctgatacgatccgggcgctgacgttcacgcgttctgggatgaaagatgcggtgactggtgtggcaacgtatcgtgattgggcaccgaccgggttgaactttacagccgtgtctgcgccaacgattgcgaaataccatgcgttgacggcgaccactcaggccgtggcaatcacggctgctagtgctgatgatgtccaaacgctaacatatgcgctggacgtcccaacaccgacgaaaccggtcaaaccgactaagccagccaaaccgactaagccgacaacatcggacgatttaatcaagccaacgacgaaaccaatcacggctgctaaaccaacgcaactcactaagccagcaacggttgtgaaggattttcaagccacaactggcaaccagacgccagctaaatcgacaaggacgttggtatcgagtcgcattaaggctgtcaaaacagctccggcatcagcaatcatcaagccgggaagtgaagtaacggagccggctcacaaggctcaagcagatacaacgagtcgattgccacagaccggtgaaacgcggcggtctgaagctgctgaaacactagggctcacactagcaacattattgctaggctttggtggttttgaagcgtaagcggcatgaaaagtaatgaatttatttaactgtgcataataaaaaacgcttaacatcctagcattggcaaaaagtcaatggaaatagggtttgttaagtgttttttgttgtgtttaggtatcaatggattgatgttcaaagtagtcgattttagttgccaataactgatcgattgcttccagatgccggatgcgatcccgaatgacttgttggtactgcttgaaagcgactacttttgcttgaccatctagtgctagatgggctggtgtcaatagacttaaatcgagatctaagtcccgaaatattttaatgagttggagtgtttccaagtttttgtgggaatattgacggtaattgtattggtttcgctgaacatcaggcagaatgccaaggtgctcgtaatatcgtaacgcatctttagtcattccagtaatcgtggtgacttccttcgtagtgaagtagtgctgttgttcaggaattttaaacgttaacacgagcgtctccttaatattgagaactgagtcgccataagtcgttggccttagaacgagtgtactgcttagataacggaacttgacgtaggcggtcatcgtagaagtgtccacttgtgtgagtgagttcgggagcagtagctaaccatgcaccaatcggggaatttttacgagagaaactttcacccagtatccgaccagccaaacgactcacccaactaccgccagcaccaaagttagaatctgggacatagccggggtggaaaatgttgattgtcacgttggttgctgttaagcgttcactgagagctaacgtgagtagtacgcgcgtagcagtggcctgggctgtgacggtcatggcattgtacttggatgtggcctgggcgtcaaagtctggaagactcactttagcatggttaatcacgaatggcggggcaccaaccaatagaatgcgcgcctgatcactgtgctttagcaacggtaataaggcttgaatgaggtccaaaaatgggtgaggtaatttaaaactaggttcaaatcataaccatctgccgataaatgtcgctcaggtagcatcacaccaatactattgagtaggatatcgatgtgatcagtcatagatgcaagctgatgagcaaattgttgaacaccagttttggtactcagatcggccaaagccaattggacagcctgattgccagttgcttgactaatatcggcttgagcctgtcgtcctttgtcagcccgactgccaacgataatcacatgatagttttggttggcaaggtcaattgcggtttgtttaccaacgccagaagtcccaccaataataacagctaattttgattgcatgtcagtcactccttcaattcgatgattatgcgcaagtataaactatggggtcgacccgatagcaagcattaaattaattatgacgtgcagtagttattggcgatttagaacataatcagcagagtccttctatgctttaaacctatgaatatgtatttaacataagcatttcacatatatagtgaacgctcgtatactgaatttaacttaataagggagggacgcaccatcaaagcaaagtatttagatcaagattatctgcaaacaattcagccaattgtcgatgctaatcagcgccgcattcaagcgttgaatgtaacccgggaaccaagtgaaattcgtgaacgtcttgcggagataacgggtcaaactatcgatatttcagtcgagattcgcgtgccactgtggacagactatgggcggaatttaaaaatcggcaaacgtgtttttattaatgataatgttcaggtcactgatttaggcgggattgaattagcggatgacgtgctgattggtccgggtgcgatgttactatccgttaatcacccgttagatctcgctaagcggcatgcggttgaagttcagccaattcacattgaacgaaatgcctggattggtgctggtgccaaggtattagctggcgtcacagttggtgaaaatgctgttgtgggtgccggcgcagttgtgacaaaatcagtgccagcaaatacggtggtggccggcgtccctgctaaagtaattaaaacaattgagcaagtagattaacggaggttttataaagatgagtattaaaggtaaagtggttgttattacgggtgcgtccagcggtattggtgccgccacggccaagttgttagcggctaaaggcgctaaagttgtattgggggcgcgtcgagaagagcggttacaggccttgagtcaagcgattggtgacaacgcggtctatcaagtaactgatgtaacagatcggcaacaagttcgcgctttgattgacttggccgtttccaagtttgggcgtgtcgatgtgctatataataatgccggtacgatgccccagggtaatctgagtgaccgtgaatacgataagtggcagatgatgttgaacgtgaatattatgggggttttgaatggaattggtgaagtattgccaatcatgcaaaagcaacatgatggtttgattatcgcaacggattcagttgccggacacgttgtttatcccgcatcagcggtgtataacgggactaagtatgcggtccgggccattatggaaggcttgcgacaggaagaaaaggaacacggaattcgttcaaccatcgtgtcgccaggtgcagttcggacggagttggtcaatacaatcggcaatacgcaaattcaggccggtatcagtgagctgatgaatgcggacgatcgtcaaggattggctttaaatccggaagatattgctaacgcggtattatttgcgatcgatcagcctaaacacgtcgccattagtgaagtgttagtacggccagcacaacaggaagtttaatcattaaatcaagtgatttaaatagtcgcggcttatctgtaagataggtcgcgactattttttcgatatattaaattaagttggtaatcctgtctgaagatacctttgaagtcttcaatggaattattgttttctggtttgaatactccggatttagcatatacaagtagtgcaaataaaatcatgagagcagcaaatattgaaattcctaagtaactatgaaattgcttgaataggactccacctatgattcctgcaagtgtttcgccaaaatacatagctgcatttgatagagaggagacagtgctacgggcattaatcgtcgtactttgtaatgtcgtcatgaaaattggaaaaatgaatccattaaatagaaaagcgagtgttagtacgatttcagcaagccaaaaagtagtaataaacggcaaaatcaaatagagcgtaatcaatgcgatgagttcaaacaagaaagttttttctaatcccattcgattaactaaattaccactaaaaagtgaccctattaagttacccgcaccaatggcaatcattgctgttcctactcctgttagcgttaatccaaagctatttgtaaaccatgtgggaaatgaaagtaatggcggtaaatgagcccgtttgaaaaattaagtatgcaaataaatagttgagtgctttggaattatgcaaaacgctagtataagttttaaagaaagaagttttgaatttatgaccaaattctaattctgggagggcaattgcatttgaaataaggagtattaatgctgccccggagattacaaagaatggtgtatgccatgagtttacagctaggtagcttccaatgggaatacccactaattgagacacagaaagaccagcggtggcatatcccataactttgacaatatgtttttgtcaacaataacaggaattgatgcccatacttgtggtgtgacgaaggatgcactaacaccggctaaaaatctaaaaaataacatcgctgggaaagtgtaggaaaagccacacaaaaatgttgacatagaaaaggctagaagcccccaaatcataacctttttacgatttctcccatcagaaattggaccgggaaaatcaaagcaaaacaggcatatccaatggcataggcacttaccatccagccagaaatactggttgaaacaccgtacattcttgccagggttgggagtagtggtgaaatcagaaaagtatcagttccaattaggaacattgttaagaaaaacattaatgagtatctgcgcataatttatctcctacgatagttttaaaaccatcaaacaatcaaccgaaaaaaagataccttatttacaaggtatctaagaaaccaggtagaatttcgttaaaagcatcaatatttagagagacatatttattttgccctttttacgagttgttgttaaacccgcttctctcaaagttttaaaatgatatgaagcggtcgatttgtttatatccaagatctcacctatctctccacaactcatctctgtttgcttttcataaagcattgctatgatgtttaaacgaacctcatctgatagagctttgaaaatttgaattctgatttcgttgttgtgtcagataattgtttgataatcataaaactatattactgttttaatcattttaagtcaataatattatatctcgattcttttacagacatattcatattttatcagtaaatacaacgacatttttagacaagtgtcgctatcgtgaatagtatggatactttgttgctgtctttgcgctgtgatcatcgttaagatagaaggcaacgaaagcctcgaattaggtgtgtcacaagtattgaatattgaggattaactaaaatagtgcatatgagcggagatggttattgatgaaagtgtttataacaggtggtacgggatttgtaggtagtgcggttgtacaagaattagtcgctaatggttttgaggtcgtcggactagctcgttctgagacgagcgctcaaaaactcattagttgggggctcagcctgtacgcggaagtttgactagtttgtcaacgttggcgacggctgctgctcaggcagatgccattattcatttgggggctttaacaatgattttcggcatttttttcaggctggtgcaatggatcggcgggccattgaaactatggggcgtgccattagtgggactaataagccgttggtcgttacgtatgggacgacgggcattagaaagcatgtcgagacggagcatgaagtcgcggatactgggctactcaaatggctcacaccgagaaaatctgagatcgtcgcacgtcagttaatggctcaaaacatcaatgcgtttgtcgtacgcttatcaccggctgttcatggtgcgggtgataagggctttactagaacagtgattgagcgtgctaaaaaagccaccgtgctgagtactttggcttaggaacacatgcttggagtgctgttcatcggttagatgcggcgcacttgttttatttagtcacgatgtatggccttgagcatccaacaactaacgagcgcgttttcaacgcagttgccgaggaatcgatcacaaccgcggccattgcacgtacgattagtcgtaagttaaatgttccattaaaggctaagtataatccactgagttttggcgacacagcgatgctttacctaatcaattgtccgacctccagtcagcttacacgacaaatattaggttgggttccagtacaaccagatttattaactgatattagtagttcacggtattaagtgggttactaaaaatattgtccaaggtagccgtatccgtgaatatattataaggcgcattgcccacggttatccataaggtgagtcccttgatacggccaacagctagaaaccggactagtcgttgatcatcgtcaacagtatctttacacagatggattagataattcaggaatgcatcgcgaaaggcgtcatcgttaaattgatgacgcaatgtttcttgaaaacgcgcattgccgaatgagttgagcgtttcaaaaggatgtgtgaagatctggtcaatagttagcttcgattgctgccgcttttgttcaaatagaggcttccaataaatcgtactgatcttgaaagtgcttgtaaaaagttgaccgatggactaacgctgcatccgaaatatcttgaacggtgatttttcgaaagggcttgtcactcagcgggttttcatatgccagtagaatcgtggctgcatccgttgatttctttgattagccattacgaatacctcctcgaaatttaatagaatacgattagtataacctgtccggtgtgccgatacaaagatgtggtgtaagcatttgaaattcagagcgcttataagcatgtgcccctgcggcggtatagtcaagggactagaattggtaagccaaccaaatattttaatgattaatcgaaaaaaacgagtgcaatagttggtatgttcatgcatacgacacgattgcactcgttttaaggtttatttatccccgcactaacaggtaaataaaatatggcgctccaatcaatgcgacgagcacgccggctggcagttcagtggtcgtcgcggtgattagttttcctaaggtatcggcagctagtaataacgtactccctaacagaccagctaacggcagctgatagcgttgtcgggatcccacgattcgtcgtgccaggttgggggtaatcaggccaatgaaactgataccgccactaatggcgacactgacgccggctaacatggcggccacgctaatcaatcccaattgttggcgtttcaagttgattcccaatgtttgggcagtggtcgtaccgagtgtaaaggcgtcgagaacgggtaattgaatgaatagaataccactaccgactgccagccatggaagcgcccagccgatataagaccaatcagtgccccacaaactaccggccaaccaattcatgacaaattgatagttatcaggtgataattttagtgtcatcaacaccattaaggctgaaaaacagccggacaaggcgacgccgaccagtaacaggcgcttagacgagatccctcgttgacgctgatttcgctaataaaaaaatcagggccgtacttaaccacgccccagctaacgcaacgataggtaaactcagcgttaacgaagcgttggtgcctgcaccaataatgagtaacataacggctagtccagcgccgttattaattccgagtagactagggtcggccattggattgttggtgaccgtttgtaagacgttaccggataatgccagggcccagccaaccatgatggcgagcacgatccgtggtaagcgaaagttgactaagactagcatgtcggtcgcattaccgcgaccagttaaaattcccagcagagcgggccagctgatggtcattgtacccgtactaaggttgagaatcgctagtccgagcatgctagcagttaagagcagtgaccaaataattaagcgacgattagggctcatgctttcatcggctcctttcgtgcaaggtagatgaagcacggtaccccgattaaggagataatgatgccaaagggcgtttcatgtggcggattaactagccgtgcaatcaaatccgcaccgaccgtcagtgttgcaccaaggatcaacgttaatggcatgctattgcggtaattagcgcccactaaccaacgcgccatgtggggaatcatcaggccaacaaaagtaatcgtaccaactaatgccaccgagatcccggataaaatgacggcacagatgagagctaggcctcgcagtaatgggagacttttccctaaactctgtgcattgtcgtcagtaagataggctaagtttagttgcggtgcgagtagtagggtcagtagcaatcccaagactagtcctggaccgagaaactttaattgtgtccagctgacggcacccaggccaccgaaataccagaacgcgaggtcctgtttgagctgcaacacaagggccagcccttcgctcagagctgttaataggctactgattgcaatcccagcgagtaccagaatcgtgggatcgagttgaacatggcgggcggtgctgatactgaaaattagtccggcactggctgccgcaccaataatggcccaaccagtcgtttgtaaagttgataactttggaaaaaggctaaacacagcgttagcattaagcccgctcccgcgttaatccccagtaagcctgaatccgctaacgggttacgcgtcactgcttgcattagggcgccgctaccagcaagagctgccccaatcaacgccgctccaaggacgcggggcacacgaatgtgccggataatttgttgatcaagattgccagtgtgtgtggtcgtcagggcgtgccagacggtggccgtacgcatctggtcagcgccaaatcgcaaactgagccccatgacgagaatgagtacgccggtactaagtgccagccacccccaatatctggacgttgacttcatgcgggggccacttcctgacagccgttataggtcaaaatcagtggggtaccgtggtagtcaacgagggtggcatcaatattgaaatattgtttttaagttagcggccgtcatgacggtggacacgggaccgtgggccaaaacgtgaccgtccttgagcgcgattaattggtcagagatgcgagccgcatggttcaagtcgtgtaatgccataatgatagttcggtgggcctgttcgttgagctttttgacgagttgcatcacttctaattggtgagtcaaatctaagtaggtggtgggttcatccagaataatcgtgtcagtatcttgagcaacggccatggcgatccatgcccgttgacgttgtccgccagaaagggtgcttaggggccgttggcgtaaatcttggaggctggcctgagtgagcgcccattcgatttttgatggtcagttgtggtgagcccacttaacggccgccgataaggtaagcggccaaaactcaccagttcttctacggtgagatcgttagccgtttggtttgtctgtggtaagactgcaatctttttcgcaaaagttttgcttttgattttgttgaatgttttgatgatccagtagaataacgccggttgttggtggcaataggtgggcgatggcacgaatgagggtcgatttaccgctaccattcgggccaatcagcgtagtgatctgaccatgcggaatcgtaattgatagctgatcgacgataaccttgtcgccataaccaatactaatattttgggcttcaatggtattcacaaataggattcctttcttaaagttaagcgttcaaggaggttcgcttaataagttaactaattttgtttagttgtgcacaatcttattttgccagcttgtttgttggaaaacgtgattaaaacaactgctaactaataattagtgttcaattgatagtcttatcttaaatgtttttattgacaattgatagtgttttcactaataattttggtagcgcttgaaaggtggagacagttgtgacaaaacggtggcaaattgtaaaattgggattagtattggggttaatgggggaagcctactattaggggcgtgcggtgcgaagcagccgacaagtacgacagttacacgaaccgattatttgaagcataaggtcaaggtgccgaagcatccgaaacggatcgtggcgagttatttggaagatgatttagtggctttaggcattaaaccggtcgtgcagtggtcggtcaaaaatggtagtggtacgcgaggcttacttgaaagagcagttgaaaggggtgccgctaattgactattcgttaccatatgaagcggtgaccaaggccaaaccggacttgattctgatggggacgagtagtgcggtcgccaatggcaagtatgcgcaatataataaaatcgccccgacctacgtggtcaaaaatgggactacggtaacgtggcgccaaactttccttgatgtggctaaggtggttaatcgccaggctaaggccaaaaagtccttgctaagtatgacaagcgggtccaaacgacgcgacaagcgttgaaaaagtctggtcagcataaagtggcggtgttgtgggtcaccaataatacggcctacatggtcaatgataattcggccagcggggccttactgtatcaagatttacaattgggtgaaccaagtttagttaaacaagtgtctaagtcggccacggcggattggtcggcggtctcgttagaaaagctagctaagttagatgcggatgatattttcttagtgaatagtcaaaagagtgcgtcgctatttaaggacccgctgtggaaaaatatcaaggccgtgaaaaacaaccatctgtaccagtatggtgacagtagcagttggcagtattcgggaccaattgcttattcacaaatgattgatatggtgaagacggacttgttgaaataatagttagtcaatcattataacgaaaaataataggattgagataaaaatttaaaacgcgtaaattactcacagtaaaataagtaatttacgcgttttattgtctatagacagcggtaatcatctcagcccaacgcgtgttgataggcggggactaataaatcatcgacaagtagatgaagggtggcatcagtaatcggttcattagcaaaagcacggtagcgaagccagtcgaatggcatcagttgtaagtcgcacgataaagttcccgtacgcagttccccacgttgctgtgcacgctgacacacgcgttcaatcgcatgggcatcaatctttttcacagcattgagcaagtccttaacttctggatttgcttgttgatctaggtggtgaaaccaagtgataaccaaagcttgattgaatgtattaatactgacagtgaagcgcttgagtacttggaataaatcttcagaaagtgtctgaccggtcaagttcacttcgtctagttgaccatggttttccgtaatgatttggtcctggatagccgcaattgcaagctctagtggtgaacgccagcgtcggtaaatgacaggcttactggtgccggcctgttccgcgacgttagaccgaacgtcaattgttcaagaccatcttgatttaagatgtcacgggcggcttgatagatggcgttttcgagttcagcgccacgacgacgtgttttagtcatgtaatccctctttttaaataagatactttaagtttcttattgactttttctttatatagcgtattataccagttatgcaaataagacacttttagtttcttaattaggaggataatatgcaagcaaaagcaactatgacgattgcctgggtcgtagtgtttggtgcgatggcaccattattagattcaaccatgataaacattgccattaacaacttagtgactagttttcatagtagcgtgacgacggtccagtgggcagttacaggttatttactggcaacgggggtcgcggtgccattttccagttggttactcaatcgatttgatggtaaagcagtctttgtggctggtgagattttgtttggtcttggctcgatatttgcagccgtagcaccgaaaatattcaactattgattatcgctcggttagttcaaggttttgcgggtggcttgattatgccactcttgacgaccttgcttgtgcaaactgcgggtgcagcagtgatgggccagatgatggcaacagttgggctacccatgattttaggaccattaatcggaccggtcattggcggaatcattatcaaatttgcatcgtggcattggatttttttggatcaatgtcccagtagtcttgatttcaatcgctttgattttgtggaagatgccgaattatccggcacaaaatcgaacagcgaaaatggactttattggtatcttgctactaattgtgtcctcaagtgctatcatttatagtttggttaatgccgcgcatactgaccgttttaataacgcgacaagtattgagatgttaattctaggggcgatagcgttgattagttatgtcgtatgggccgcttggcaaaaagaacgggcggtagtgccactgcacttatttaagatttttgcatcatttgatggtgctggcttaggattgtttatcgctgggacggtattgaacggcgcaatgttgttactaccactctattttcaaaacgttcggggaatgagcgtgattaacgccgctctagcgctattacctcagggagcgggaatgctagtttcgcggacgttaacgggaaggctaacagatcaaataggcgctaagtacgtggttctgggaagtgtcgtcatcacgtttgtcggtaccttaccgttttattggtttggtcaacagacgtcttactggattttggcacttattttatttgtgcggggaattggtgctggtggtattttaatgccgttaatggccgatgcttatacaggaatgcaacctggacaagtgccagctgcaacaattgggaccagaattatccaaaatattgggagtgcgtttggatccgctttgattacgacgattgtaacggcgtattccacacaccaagtgaatgtgtttgaacgacacctaaaagcaggaacgtatcacgtcgtcgcagctcacttacaagtctttacaacaagccatttgcaagcaattcgcttagcagcgtttcaacaaggctttctagtgattgcaattgccgcaatagttattattttgccaaccttattgctgactaacaaattgaaggcggcgaagtaacccatggagaatttcatttattgttaatcagccaagccgttttcgggcctgtattaagtaacagactaaaaattcgcggcccgttcagagctgcttactacgaactggttaagcaacgattgattgcgacagggcatctcgattacctaagtgcgtttttgtggcactggcttaattcgttaatattccttatagaattgaaggacccaactgtataagcttttgagattaataatcataacttcaagataacagtgacaggcgcagcagttcattgatatgatggtattaaacacatcttgcgaggcaatactttttcgggggataagattgaaaaaggtctatttacgatatcaaaaacaagttgatagttttatcaatattaataagattatgttgatgcttgagtttgttttactatttgtagtgaaaggtagtatcgatcgttataaccagctaccatacgattggtttgcttatttaacaacgttgatacattactttttaggaacttttactttttcgggattattctagttattgaatgtgtctggaacaagttcaaataatgattgtgcatgtgtaaatctagtacaagctggcgcgtgacaatttaatgttacgcgctttaatttttaagattttattagttagagatgcttttcacttctgctaatccgacgctttaatatagaagttgttcgaagatactatgttaaattcggctagtttaaagacttgtcaatggtaatctgataacttggcggggactagtacaaagaacagttaaaaccggttctgtttaattaagcggctagatttgaaggatggcatgtgccatcgccaaatactgctaagaagcgttcttcagcaataaaactgatgactaattgttgacaaacggagtgaataccttgtacatctggcttagctaccgccactactttttcaaattcttggtcagtgactggggctttcttgagttgcttttcggaaaatgcggtcatcaaatcaataatttcttggttcgaaaatcatagttcagtaaaactaagtcactgcttttgagattagtttttcggctagttcgtttaaaacatttaataaaagtgtttttctagaaaagattgtcatgattgcctaccagttttataaattagtggggcgttgagcttagcgctgatgacgttactagtactatcatgattcagtcacattaagcagcccattgaatgatttttgaaaacgatacgcctttacaatgtcagataccattgtatcttatttatttaggacggttcggtcaaggtctgctagtaacaattacaaatttgagcagtaactgtatgctactgacagtgcgcttaactaacgagcaaaaaatagacgctatcagtgtattctagcagttagcaaaaaataattaaatccgcttgacttatagtcggctctaacaactattattagtctcgttggcagatgtttttaactataattcatcaaaaaggggataacaattatgaagacaattcaaattggcgctagtcagctcaaagcgtctgcggttgcgctgggtattatgcggatggttcgtttagataccgatgcggcagcgaacgtcttagagaccgttcatgaccggggcgttaactttattgattcagcggatatttatggtaacggtgattcggaacggattttcggcgggcattaaaacagtcgagtttaaagcgtgaagacttttttattcaatctaaaggtggtattgtactcgatcctgagaagagttctggtgaactagtctttggtcaacgctatgccaacttttctaagcagcatttgattgcaacggtcgataagatcttgcaacggatgcagctggactacctagattcgtttctattacaccggcccgatccgctgatggatcccgccgaagtcgccgcggcgtttgatgaattgcaagctactggtaaggtgcgtcacttcggtgtttccaactttaacccgatgcaagtcgagatgttacaagcggcagtcagccagaaattgatgatcaaccaattacaatttggtgtcatgcacaccggtccaattcagtttgggttgcacacgaatatgcaggatacggctagccttaatcatgatggcgaaattatcgaatattcgcggctacaccacatgacgattcaagcttggtcaccctatcaatacggcatgtttgctgggacctttattgataatccgaagtttccagaattgaatgcgaaattacaggaattggctgatcaatatcatgtgactaaaaatgcgattgcgatcggcttggattttacgtcacccggccaatatgcaggtcattttaggttcaatgaatccgcaacaccttgatgagagcattgcggggaccgatgtgacgttgacacgccaggaatggtatgacgtttactttgcagcgggcaatgatttaccttaatttgaatagtccttgtgatgattaattaatcataataggtttaggttctttcgaaacggttactagtctcgaaagaactttttttgtgtggtgcaattgtggttgttataacttggtgtattgatcaattgctgaataaagtcagaattgactttattggtagttaagcggtattaatcataaaattgagtaatgatagattataaggaggaacgattatttgaacaaggcaagattagaggcgtttacagatgcgattatcgcgattgttttaacgttattagtattagacttaccgcggcctcaaactccttcagtgcgggcactctttgcggaatggcaaagtatttatgttgatatcattacatttacactattgatttcaatttggcttaatcatcacgatttattcgtgcgggttaaaaaaatcgatcgggttgtttttgggcgaatagtttctggttgctatgtcagtcttttattccattcatggcttcatggattactaaatttccgcattcaaaatggcccgcagtattttatattcttacgggttttgtttggatgttggcttatcagttactagtagccgccgttagaagattaaatccacacattcatcgtatgagtagtccggcattaagtgttgtttttggtggctttttagtggttctaacagtcgcgttaattaatcccgatgtgggcttgttcctaatccccgttcacgcatttgttagtgttattttggcgactaaacgtaagtggcatttacgcaagtatttttaatataaagatgaaattaaaaagtaggctcatatctggtttaggctagtatcgcaatgcataacgaacgacaacgcccgcaaggctgaatactgagtccaatcttgcgggcgttgccggttagtatttagtaggtgttagtaggagtgtgcttatggtttggtgacgattcctaggtcaatcatagattgggcggttgcaataatcgattccgcagcgggacggggatgccaatccaacaatgtttgggctttatgattgctcgtttccgcgtaggtgccaactagtgaggcgaccattcgcaattctggtcgggccttagcggctagcttaaccgctgcattggggatggttttggttggtagctgactggcaaaagctggaaaggcctgtcttaagacattcgcaacgtcaagcatggatagtgtttcacccgttgtggctagaaaacgttcgccgttagcttgcggtgcgatcatagcaagcaagtgcagactagccacgtcacgaacatcaacataaccggaatcaacgtttggaacggctttaacttgacctttatctaagaattgttggatttgaatattggaatgtgaatatttggcggacaacaccggacccatgacggcaacgggattgaccgttgttaattctaacccgcggccctcatggttaataaagtcccaagctgctaattcagcacgtgtcttggattcttgataaggatggatcgctttccagttgagatcagaccagtcagcttcagtgtagggggtcgtacgatttttgtgaccagcaaagatggccccgtacgcagacgttaacacgactcgtttaacgcccgcatcacgactagcagttagaacccgccgaacaccgtcaacggctggtcggatcatttcagctttgtttttgaagttgagctttggggttggggaagcgacgtcgatcgcataagtggctccggccatcgcttccgaccagtgttcatcatgcgccaggtcggccacaacaatttcgagagctgataagtcggtgataccaccattggtcagcatttctctgttaataacgggtgctttggctaatgagcggaccgttgtgcggacggcgtagccttgttgtaataattgacgaatgatatgaatggcgataaaaccgctaccaccagtgacgacgactaattgtttttgcatgggactacctccaaatgaatttatgaattgctgttacacttgtaacgtctgtgccagtatcttacaatggggtcacgacgaatacaaggtaatcacgagcatctgtgacagaatggaggaattgttatggcagcgaccaatcacgcgcaagcaatcaaaaaggattcacaaacttatttaactacggccttattacaattattaaggactcatgatttagatacgattacggtgacccaagttgtcaagcgagctggggtcagccggatggcctttaccgtaactttacgacactcgaagatcttttgacagcgtacttcgccccggcgattgcagcgcggtttcaggacgtcttgcagcatgtacccggccaatcggaagttattagcgatgggtcaattttttagtgattttgcgccgacgttacgactggctgagcaacgtggttttgaaaacattattcaacaactttttaacgctaatatgactaattattaccaagcaacgatgactaatggaatgctcacggcggtgcagcttaagtattggacaagattcatgagtgccggggtatacgcaatttggcgcgaatggctacttggcggacagttggagtccttaacaacgattcatgaaatactagcaactttgcagacagcaacgatgcgggcgctgactcaggctcaaaaatgagcagtggaagaatgatcctaaattagcggtgtgaggaggtcgaaacgccgattttagcgtgttgattgggtacttatgagcaattgtaaaagccacctagccatgcaccggcagagctcggtgcggttaggtggctttttaatcaaatgagctgagattaagcatcttgggccgttggcagcaatgtcaacttcacggatattgacattttgcggcatgtcatacatgaacttgaccgtggcagctacgtgcttggggtccaaagtcaggccacccatggaagctttccatgcttcgtaatcggacagtgccgacttgctagtaacgtgggttaacagctcagtttcggctgcaccggggctaccagcatgacgcgcacgttcttcggcgcattttcttcacggagtgtctcggatagcccgtggacgccaaacttggatgcaacgtaagcggcgtgattgacgaacgttttcttgccagctaacgatgacatattgagaatcgttccatgttcccggtcacgcatgtcatttaggacaatttgagtgccgtttaaaacacccatcacgttcgtattaagcatggtttgccactcttgtgggtcctgattttgaacatttcctagtaacattaatcccgcattattaactagtaagtcggtcttgccatacttgggcttcggccttgcgaacggcagtttcgaattggtgatagttggtcacatcgactgtgtcgatcatggcattttcaaagttcgcagataaggcggctaactttgcttggcgacgccctaatagtaacagtgggtagttgtcagcggcgaataacttggcaatctcggcaccaaagccagaactggctccagtaatgacgactaatggtttcattttgtaattcctccgtaattttggataatggttttcgtttgaattttcaacgatttacagtatacttggctagattaaacgcgacaagtacgcacttttaggtaaccaccaattgagagcggggagttaataatgttaaaagaacgggtaactgcgcaaccacgctaccgaaatgaatttgatgccacgatgcagttgattcgtggtaagtggaaaatcatgattttgtttgaactggccgaggttaaagtcagccgttttgctgacttgcaacaccatattcaagcggtatcgcataaaacactggcgagtcaattgaaggaattggaacaagatgagttgatcgaacggcatgattttaagaccgctcagccgcatgtcgaataccggttgaccgctaaggggcagagcttgattcccatcctagatgcgatttgtacctggggtgatcaacatgttgatccagctttgattgaacgttcactgtgtgacgaataggctagtctaaacgggagcgtgggctttgtacggcgccatgggaaaagtacgttgtcagtcaaaagcaactagcggcgctgttttgatgaccattactaaataatcgcttcaagaatttctaatgacattcttgaagcgattatttgttattcaattaactcgtgctgtttgaaagctgacagccagctatacgggctgttttataagatgaaccaactattgccgccgggatgggggtgggtcgttatcatagacgagtacaacgcggaatcgatgatttgaattaatcgattgccgttacggtgacagcgacgacatcgccaatgcttttgtggagttttgcacgaatatccttacgaatacctaagatataacaaatactaccatcaaggtttttaacacccatattaacgatagaaccgttgtaagggacctcatcgaaagtggcatggactttgacgcgccccttaccgaaaaggtcgcgaatatcgaagggacaggccacgtaagccccacctttgccaattgttgcggcttgaatcggtgcgtcaaattgataagtcttcattattatatgacctccgcctaagcgtaattatggaacggcttcatttttataatcagatttccatattatcatagcaaattagcaattgttggtgaactaagtggtcactcacaactaattataattaaggtgaaccgctatttgcgtgaaatattaaccgggtatatcgttggtatcaaaaatatttatcgaaaagtacaattattatactaaatccccttgcgagcggggcaatcaaccgcttataattaaactgctttaagtaaattaaaaagggtgtttacatgaattttaaatcacaaaatccaattgatgcaagtcagtcggaaagattcaagctttataagtcggggaaactttggctggttgctggattaactttcttctcatttttaggaggttccgttcttaacaatacaaacgtgcacgctgatgctacaaatgcaacgacaacatcgtcttcagctgcaagcacggcctctagtgcgagtgttgcaacgagctctgctgctagcgatgcgacgactaaagcgacctcagtttcgtcaagtgctgcgactcaagtaacgagtgcggcaacaactaagacgaccagtcaagcagcgacggcatcgtcgagtgcggccactagccaatcgaccagtacagcatctagctcgactagtcaagcaactaagacggcttcgagtgcagccactagtacttctgcaacggctacaagcccaagcaaccagtgtcgcttctagtacggcaaccactactcaagtaagtcataccgcaagcagtactgctgccagtgctgcttcaagtactgcaacggtcaaggctgttaaggccgcttcaagtacggtaagtagtgcggcgacgaccgctactaaagccacagctaaagttgctgccgttgcttataccgcagcaacgacgtcttcaacggatgtctggacgattggggatacgactcggccacgcgttgatgttgttgacgtggcgtcatatcaaagtaccatgacgcaatctgatttcaataagttaaaggctgcgggtgttaagacggtcatcgttaagtcgactgaaggcactgattacacgaacccagctgcactgaaccaagcaaagatggctaacaaagctggcttgaacgttgatttctaccactatgcaacgtttagcacggctgatgcggctaaatctgaagcgactaacatggctggtttcttagttaagaacaatgtttcaaccaaagttctcttgttcgctgacatggaagattcatcttcatactcagttaacgcaacggcgaacttgaacgcgttctggtcaacgttagattcctttggttacaagaatcacggcgtttatacgtccaactcatacttatatcgggatgctgttgttaagacagttggccaatcacgtgtatggcgggcccaatacccatacacgccttctgctaataacctttggaacaccaatgatggtgcatggcaattctccgatacggcactcttaccatctggttcagattataccggttacattgatgtcagcatcgattacaatggtttaactgaagatagtgccgggaccaatacattcgtaacgacaactagtagcaatgatacgacgactagtgaagtaacgactgacactagtgctacgaccaatacgtcaactagttcaacgactaagaaggcctctggttggtatacctttaccaagaaacacagccatcaagagcgctgccagtgacagtgctaaaacagttggaacttatagcaagggtaaccgcgtttactataatgctgaaattacaactaatggtgaaacttggttacgttacttaagttacagtggtagcgaacattttgttaagattgccgcagctaaaacgaccacgactaagccagccgcaagcactagcaagacggttaccaagaatgaaactggcacttacaagtttactaaaacgacagctatcaagggttcagttagtgactcagctaagactttagggacttactacaaaggtgacacggtttattacaatgccaaggttactaagaatggtgaaacttggctccgttacctgagttacagtggtgcgcaacactacgttaagatcagtggtgcagctacgtcaacgactaccaccaagccagccactagttctagcaagacggtcactaaggctgaaactgggacttacaagtttactggcaccacggccatcaagggttcagttaatgattcagccaagactttagggacttactacaagggtgatacggtttattacaacgccaaagtcactaagaacggccaaacttggcttcgttacctgagttacagtggtgcgcaacactacgttaagattagtggtgcagccacaacaacgacgacgtcaagcaagtcaacggctacggctagtgctaagacagttgcgcaaagcgggacttacaagtttgctaagacgactgccatcaagtcttcagcaagtgatgccgcttcaactgttgggacttactacaaaggcaatacggtcaactacaacgccaaggtaacgactaacggtcaaacttggttacgttacacgagttacagtggtgcgcaacactacgttaaggtcagtggcggtgccgcaacgaccacgtcatcttcagcaagtaagacgacggcggctgctggtacgtacacatttaagaccacaacgaatattcggaccgctgctagtctaaatgcctcaattgttggccaatactccgcgggcgaatccgtttattatattggaacggtttctgcggatggctatcaatggctgaagtacttatctaactctggtgcttaccattacgttgctaagattggctaacaattagttaccaattactagtgcaataacaaaacaggctttgagatcacgtcaagcgacgcgatttcaaagcctgttttgttgtgtgattgagttagtggcctgttcatcttattttgacaaaagtcggcatagacgcacttaacaaaaagtttacactgattcgaacttctttcagcgggcctaagctggtagcttttgacactaaaagtttgaagcatgcttcgtattcaagcacgtgtaatcggtgctgtagtgaggggataatgtttataaaacaactaagccaccagcaccgttgtcgtagtcaggtttctgagcagtgacaaccagtttttcgttaacaaagggccattaagcccaggctgcttaactcgcgaccatagccggagcccttgacgccaccaaatggtagttctggtaaggagctgaggaaggtgttaacgaagaccatcccagtttcaatttgttgggcaaccgctttgccatgcgccgcagttccggcgaagacgatgccacctaagcccagttcagagttgttggctaaatcgatagctgcttgttcagaatcaactttgaagacttgggcaactggaccgaacatttcttcgtaaaagagggggttgtcttgatcaatgtccgttaagatggttggttggaagaattggccaggtaagtcgattggttcgttgccataagcaacggttgcaccaccggcaatggcccggtcaacttggtcttgtagcttttccttagcgcgtttggaattcatcggtgccagggtagtttgtgggtccataggatcgccagggactaatttggcaaaacgttccttcaactttgctaagaaagtcatcgtacacatccgcagcgacaataaagcgttttgatgaggtgcagacttgcccagcgttgtataaccggacccgccatgctaagttgactgcttcgtcaatatcagcatccgctaagacgacgaaagcgtccgaaccacctaattccatagaactcttcttcaagtttgcaccggccgctttggcaaccgcttgtccaccacgcttagaaccagtcagtgcgacgccttggatgcgggggtcggcaataatatcgctaacttgatcatagtttaagaagaggttcgttagactaccagcgggagcaccagcttcttcgacaatcttggcgaaggccgcagccgatcccggtgtattagaggcgtgctttaaaatcattggattgccgaccatgtagttcggtgcgaagacccgcatgatttggtagtatgggaagttccaaggttcgaccaacatcaggacaccggttgcttgtttttcaatttcggcatcgcccgttttgcttgagtgctgattggggtcggtgccaataattcagcaccgtgatcagcatagtaatcagcaatcatggcgcatagttcgacttcaccttgagattcactcagtaatttacccatgtcgattgttgcaattttagctaattcatctttatgttcacgtaacagtgcggcaatcttatggaggctggctgcacgggaactaacgggttcatgacgccattggtgataaagggcgtcgccggtagttaaggcctgttcgatttggtcagtggttgcgttgtcgtaagttttaacaacttcattggtatatggattaattgtttgataagccatagtaaactcctcctataaatgttcaggtattgtaaacggttaatctgcgattgtatgggactggtaaccgccttcactattgtacgctaccacaaaagtacggacaaagtcagctaatttgacttgaccagcgctagtgtcagaagcatttagatctgcataaagttccttcaggttcgcgctgatagcgactagtttggactaatgaagcggcaattttaacgggaacaccgtggttcgtcaagttagcttgatattgttcatctgagatttgtacccattgtagatcgggcatgtttaaggcgtcgcgcagatcagcaacgaattggtcaccggtgaacgtatcactgaaggcatacttgacggtgataccggctggcgtgtgatcaattaggggataaacgacactggcaatgtcctcgggcgcaacgtatttttgtgctgaagcagcaggcgtgctggaataaattttatgttcagccttgattgttgctaagttaccgaacaagttagcataaaatccggttggacggacaaaagccaggttaaccccgtcaagttgtcgtaattcatgttcaattaagttgtaagcatgcagcgagccagccacttcatcggcatctgcgccgatgctactgaggttgacgacgttggtgacgccggcatattttttcaattgcctgtttccaaattttagcctgagccacggccccttcgaagggatcatcaccgataccaccagaaagcatgagataaaccacatctttgtcagtaaaagtggtggataagaaatcaacatcagtcattgtaccaatggcggcatgggcgccgatagcttcaattgaagcttggcgcttaggactagttgagataacggtgacgtcatgaccggcttggacgagcttaggaacaacgatccgattaatgtttcctaatgaacctaacattgcaattttcataattatagaacctctttaaaatttgatttttatttttaaaagataaatctatctttcaacgatcactagtttaaaagatagatttatctttgtcaagcttgaaaaagatatttttatcttttatactgaagacatgaagaaaaagatatgaacaaacaagttaagattcaagatgcggttgcggctatcattctcgctgagggtccagccggggtttcaacgactaaggtggctaagcgcgtcggcattgcacaatccaatgtttatctctactttaagaataaacaggctctgatcgatagtgtctatgcgcgtgagacgaaccgaattcttagtactaccgacttagaccgattaagtgattcaacaatcgatgtgacgactcggattcgattatatgtacagcggtgtatgactattcgttagccaatccagatagcttgacgatcattcaacagatcaaggcattgaatggacaggggatgacgatttcggcggcggatgccgatccgaataatattgtcgctaacttattaacggcggctatcgatgctaaggtgattaagcagttaccggttagtttgcatatgggggtcgtgttttcaactattcatacgcatacgacgaatatcagtaagggacggtatgctcaggaccaatatacatttggtgatattttccaaatgatttgggacgcgatgaaacaaggattaggaggtttaatgacaaaagacgcgacttaattgataggcacgagtggatatcaattaggtcgcgtttttttgcgttcatgtagcgattagtcgtcttgaaatgacggtttagtatcttaaaggctggttgaataattcggttcattgtgtattcttttcaagtgtcggtgagtgttttaaactgtaggtaccagtttgagcaaccaatatgtaaggggactttgatggtacagtgggcaaaacgattcagtgaaacgaaggaaccggttgtattgattagtcataatcaaaataggtgtgccggcaaaatagtggtgttaatgatgagtaggctggagttgtggggtagctgatgaagattatttttgtgcaaacgctgttcctattcttgtttgttaaggtgcttttgcgtgattggcgggtacttagtatttgggatatcagttatgcggtggtcagtagcctagtgagcggctggatttttttcagtaatcccgggcaatatgcagcattgccattattgggactggtggtgctgtttacttggtggcatacacatagcttcagtgagtcattatttgttagcctacaggtgattatctggtcaattgtcgtcgatcatatcagttcacttttaacgtatatgttgaaattagatgacgggtatcttttgatttttatgggattacagctggttggtttaatcacattgaatctgattttaatgaatacgcatatccagacgacattcaatcgtcccagactgaaccgggttacggccttgctgctactcgccatctatttatacattattgtcagcgagggcctcgacagtgaattgagaatggtcgtcagtaacttagttgtgttgttggtcgttatggggctcgcgattgccatctatgatgagtatcgggttacgattcgggccaagtaccaggttcaacaacaacgcccgcaaatcaaaaatgatacacggtacatgcatgaaatcgaaacgcattataatgaattgcgccggtttcgtcatgattatcagaatataatgttgtcgattaatgagtatttgaaaacggatgatttggcgggcttacagcaatattaccaacaaaatattgccccagtgaccaagcgcgtttcggatgagcagtataatctcgaagatttaagtcgtgttcaggtcaaatcggtcaagagtattctatttagcaaactcagctatgcgcaatcacagggagttaaagttcaatttgacttgaagcaagtgcttaatggggtaacgacgaatgaattagacttggcaattgcgctaggtattattttagataacgcgattgaagccacggccggtcactatcacggtgagctgatgagcgccatttttgttacggcccacagtacggtgttcttagttcaaaataacgtttttgattccttgccacctttatggcagctaaaggaagcggggtattcgactaagggacaagagcggggcttttaggcttgagtcagctcagcgcaattgttaatcgaaatgaaaatatgatattggaaacgcggttattggcctcagcctttgttcagcgtttaacggtaaagggaatgataaaatgatcaaagtatatatttgtgaagatgatactaaacagttacaaaccttgcagcaactggtcagtaaagtgattattgatcgtcaattggatatgggatttggcctaacgagtgccgatccgcatgaaatattagcgcatgtcaaaagtcagcaaccaactcaagccgtctttcttttagatattgcgttgaattcggatattaatggcattcagcttgccagtcaaattcgtgatttaggcatccgaagtaagattatctttgtgacgacgcatacggagctatcattgacggtgtttcagtatcaagtggaagccctggattttatcttgaaggattttccggatcgcttatacgagcgattaaataccgtcttacgcgtgggcacaggagcgtttcaaagctgaagacaatgatcaaaatagttatatccaaatcaaaattggcgagacgattcgatcgttggacgtgcaacacgtgttattttttgaaagttcaatgagtccacataagattatcgttcatttagatgatggtgaacttgaatattacggtttattaaaggatgtgccggatttgaattctgatttttatcgttgtcataagtcatatgtcgttaatctgacccgcattcggtcattggataaacggtatcgtcaactaacgatggctaacggtgaaaccgtcctgtgttccgcagcggccagtcgctacttagtaaggcagattggcaaaaacaatcgctgattgaaatcttagtcgatttatattgacggcagtaaaattcagattggcaagattcggtttgctaactagtaaaataatcgtttcagcaatttgatttccctgaaacggttatttttttacgctttattcaggtgtattgcccaattatagacctaagccattccaatcagttcgcgcacatttattttgaaatgatcttcaacgggccaaataaggtcttaatggttagtctgcctgtcttaaaacggccgttgcgacgggccacactaaattataattagaagcaaccagtttgaatcaagtgggttatgttcgctacaagtgcggctgttaattatggtcaaggcgggcttgccgttattccgcaagtcaaatcgccgtactgggcattgcctatgatttgagcgtgacttgtgattggtcactaacgataatattggtgattagtcgtaataacttaagtgtgggagtgaatagaatgtgtggattggttgggtgcttaacggatcggcgaaaagttgataatgccgcgtatgatcaggttgtgcgggaaatgactaaaatgattgtgcatcggggtccggatgatgaggggtactttgcggatgataatatcacgatggggtttcgccgattaagtatttattgatttggcggtggtcatcaaccgctgtcatatgataatgaacgttattggctaacgtttaatggtgagatttataactacgttgagctacgtgaacagttaattcaagaaggctacacgtttaagacggattccgattcggaagtgatcttagggatgtacgccaaataccaggccaagttgacgaactatctgcggggaatgtttgcctttgtaatctgggataagcaggaaaaaacgttattcgcggcgcgtgaccaatttggaatcaaaccgttttattatgcgattgccggggatgatttttactatgcgtctgagagtaaggcgatttataagattttaaaagataagcattttgatcaagaggcattacaagattatttgacgttccaatatgtgccggaaactgagaccctgacaaaggaaattaagatgctggcgccgggctgttcattaacaaaacagttgggacacgcgccgcaaatcaagcgttattatcatcgggagtttcatccagtcgtccgttctgaacaggactacgcgacacggcttaaggagacgttgattgattcggttaagatccatatgcgttccgatgtcccagttggggcgttcttatcgggcgggattgattcgtcaattgtggtggcgattgccaagcagttcaatccaaatctcaagacgatctcggtgggctttgaacgacctggctatagtgaattagacgtcgcacaggaaacggctgctaagttgaatgtcgataacgtccaaatgaccatcacgccggaagcattcatggcagcctttccacattttgtctggagcatggatgatccgttagctgatccggccgctgtcccgcagtatttcttgactaaggaagccgtcaagcacgttaaagtttgtctcaccggtgaaggggctgatgaactttttggcgggtatacgatttatcatgaacccgaatccttgaaagcctttcggtatacgaagccaatcaacggggcccttcaacggatagccgcgatgatgccagcaggaatgcggggtcgttcgttgcttatgcggggacgacaccgttagagaagcgatacgttggcaatgcgtttatcttcaatgaaactgagaagcaacagttcatgaagcactacaatcgtgaccattcgttccaacagacaacccgggtattttacgatgaagccaagcattatgatttaatctctaagatgcaatttatcgatatgcacacgtggttaaatggggatttgttgcataatgcggaccggacagcgttagcccacagccttgaattgcggacaccctttgttgatcgggaggtgttcaatctggcagcggaaattccagccaacttgcgaattagtcacggtacgacgaagtacattttacgaaaagcggttgaagatattgtacccgcgcacgtgttacatcgcaaaaagcttggtttcccagtaccgattcggttgtggctcaaagatgagatgtacgattgggctaaaaatattattgtgacgtcgcaaaccgatcagtattttgacaagacatatttcttaaaactattggatgaccatcgagcgggtattcgtgataattcgcgtcaattgtggaccgtgctgaccttcatgatgtggcataagttatacgtggaagctgatatgttaatggatagtgtaacggccaatcatcttgctgagcaggtcgaaatcggttaagctgttcatattaaagctaaataagaactcgttcaacgtgccaatgagaataaaaatcatccagcgacctgattgtcttaatacaaataggttgctggatgatttattttggtggttttgtagttgtttcgttagtcgatgacgactttagtgccatacttgatgttgttatagacccacttggaatctgcaacgctcagatgaatgcaaccgtgtgaagacggtcgcttgccaagatcagcagcgtctgatttgttgataaagtgaccttgggcatctacgggtgtggagtggaacaaatattcaccatggttgagccatgagacccagtaataggcaccttcatcaacactagcgctataaaaatattttccccgttcggcttgcacatgataggtgccacggggtgttttgcggtcagcagttggcacgccactggatgcatacattgtatagagaacgtggtgatggttcatcaagtatagccgttgtttagccaacgatacgtgaatccataagtccggatagcggttgacattgggatacgcgactgtttcggatgattgacgccagttgattggtgtgcgcatgaccgttggtttagccgtggttttggctttcgtctttgacacgactttttggtggttaccgttgattggctaggtctgtgggcatcaccaacaactttgacagtgccgaccgccagtaagccgataactaaagtgatgctagttaataaaattaatgttgatttgcgttgcatgttgcgcccccatagttggttggttctgtctggctctgacttgatagttagtggtaatagtcaatactgaccattcaatcaggaccttctcagtaaaagtggaaaccaatcgtatattaccgttatagctttctgaaagtgaaaatgcaacccagtcgaatgctgggtaagtcggttttacgaacaaatcggggtcgcgatggtgtaaagcgggtatattcgggctttaagtcaattaagacagcctaaaatggcaataattggtcttcaaataacactgaaaataaacaataaatcccaactaaaagtaggaaggctgccggtgaaaatcgggacgattcattgctaacattccgagtcgcctcctaatgaggttcctgaactagtgacggttaagtggatttaaaagatagtgacataaagaaaaacactcagcctagcgataggacaaccgaattggcggtcattgttaagccgctaagcttagtgtttttcgatgaccgtttaagacgactacgggtcatttagttattaattttgaacgcaatgccggtcggtgcttttgcgggccgcgctaaccaaattagacctaacaataggactaagctaacagcaaccatgatggcaccaaagatcggtgtccagcctaagccaaggttggtcgtgacttgaccaccaataccggagccgagtgcgataccgacgttaaaagcggaaatatttaacgctgaggccatcgtaatatcgtgtggtgtattctgttcagctaactgaacaatatagagttggagcccagggacgttcatgaaggcaaagattcccatcagtaggacggtcaatagccctagccagtgactgtacccggtgacgcttagaatgagtaaggtgatgagtaacccactgaacatcttgaatagtgcaattaagggccgtgcattggcccaacgaccacccagtgtattaccaagggcgaccattaagccgtaaacgactagaatcaaaacgacagcgctcgctgaccaatgcatctgctgttctagtagtggtgataggtaggtgtaaactacgaaggtaccaccgtatcccagcgccgtgacgagtaaggcgaacagtagttgtggattagtgagtacgcggataatccccggaccgtggctatactgggtaacggcagattacgtggaattaaccagtaatcagctaacaaaccaatgacaccaatcatgctaataaagataaaggaccagcgccaaccgcctaattgaccaatcatcgttcccaacggaacaccagtaaccgttgcgacagtcagtcctgtaaacatgatggcaatcgccgaggcccgtttggcgggtgcgaccacgtcagcggcaattactgaggcgacggtcataaaaataccgtgagccaaagcggccacgacccggcccgcaagtaagacaccaaaggttggggcacttgctgcgagtaagttaccaataataaataagaaatcataattaacatcatcaagcggtgacggttaagccgaccggtgagtaatgtcatgacgggcgcgccaatcatgataccaatggcgtagatcgagacggtcagcccagcttgcgccaagttgatgtgaaagttgctaacgagtagtggcattaaaccaacactaataaattccgttgacccaatggcgaaggcactgattgcgagtgcaaaaagtgtccaactgggattaaactgttttgtcataagataagcctccgctattgctaagttgataaataatgattatactagcaagtgacttttagacaagtaccgactttaaagtgggatacccactaaaaagtaagtatggaatggagggacaattattggaaaccaaaacgtatcatattggggtcgaggccacaatggaaattattgggggtaagtggaaatcaattattctgtgccatctgcgtactcagacgatgcggacgagcgaattggaacgcgcgagttttccacaaatctcgcagaaaatgttagtacaacaacttagagagttggaagccgctaatattgtgacgcgcaaagtgtaccaacaagtgccaccgcgcgtggaatacggactaagtgattatggccggagtttgtccgttgtcttacatgagctgtgcgtgtggggtgaggataatattgatcgccgccgagctgcgggtgaagagattgccttgttacatcgagacgatttatagacaatgagtttaaattaaaaatggtgcgtcaagaatgaaaatattctggcgcaccatttttgattaggggagttaatgttgggtcggttgacgacgattagacagtaaactgtaaccaaaccagctgactgtgatgatagcctggatgatctgtagtccaatgccccaaggattcggcaaaaagatgaatacccaagaaccaaaacgtggcgtaactaggaagagtccaatcagcataattagggccaaagtggttattaaaattccaaccggaacggtttttcgcttaaatggcgtactatcagcataaatcgcatgattcatgattttaaaaatcagtgctatggcgataatctcgactagtggggcggcgaaaagaagtaaccagttcagacgaaatcctgttgccgtattagcatttaatataacgaagaaccagctaatcaggattaacaggccaacaaagtgaatttgttgccagcgactgttgcgcggtaattcggctaggagtgcatctgcgagcccagcaggatcgttaccaaaaattgtgaggccgtttcaccatgctggctggcgtctaggaagtcttgtaacatcgtcaaaagttggcgtgtaatggccttttcattgcttccgaacagttctttggtcagcaaataaaggcgtaaatcttggaagtattgcgcgtcactaggggtgagttgttgttcaagttgattgagctgtgcctggtcattatcaattttggtcatgatggggtcctcccctcgttaagatgtgatcgacatgcgtttttaactgaaaccactggtgattaaaagctgttagtgtttgtaaaccttgaggggtaatggcatagtattttcgctggggaccatcaggagaagttttgaattgcccaatgagatcgccgcgattttccagttttgcaagtaggggataaagtgtgccaccaacgattgagtcaaagccgtcttcacgtaacgcctgaatcaattcataaccgtaaatttcatggtctgaaataatggccaatacacacccgtcgagcacacctttgagcaattgtgtttgtttcaactagtaatctcctttaactagatagtattactacctagtagtataagtgttaatcgccaaatcggcaataaccagatttggtttgaaaatttaatattagtagcaatgactccgcttacatttttaaacagttatgataagcttagattattgacgataaatagactggagttggtgagtatgacggaaaggcagttatttttgatttagatggattattgattgatagcgaggttatttcattaaagatgtatcaacgaatcgtacaggattatgggcagacgctttccatggcgacttatgcacaggaatacagtggtaagtcggcggtgacgaatatgcaacacttgattgaacgttttgacttgccgtttgacgttgatactggattaaagcgggcgttagcgttggaaaagacgtttatgcgggatggcgttgagctcaaaccgggagcacgggtgttgttacagtttttacaccggaatcattattcagtggccttagcttcatctagtatcaagtcgcgggcattagacattttgacgtcccatgatgtggcgcaatatttcgaccagtttaccttcggaccggatgtcgatcgtggtaagccatatcccgatatatttttgatggcatgcgccaaactccaacaacaacccgcagattgtttggttctggaagacagtgcaagctggcattcaagcggcgacgtccgcgaagatcccggtaatttgtgtgccggatatgaagcggcctaatcagccctatgctgatcaggcgactgcgattgtaccgtcgttaacggatgtgataacgtatttaaaatcagttcgataagattcagttgtaattaaagcataaagattattaaattattaataaggagcggttgtccgatagaaaaactgctatactacgaggcgtaaataaatcgctgacaagttagccagtggaacgaaggagtcttgatcaatgaagaaattgatgattgctgtaactggtttagccatggtggcaacgctgggagcagcggtacccgttacagggattacagcgaatgcggcgactaagaagacaacggctacgaagaatgtcgcaccaagtttgaaggtcaatgcaatttacaataatacgacgcaaattacaggtacggcaaccaagggcgctaagatcactgtaaaaagtacacacggccaacgccaagaaaaatcttggaactgcaacggcctctaaaacgactggaaagtacacggttaaattagccaagacattgaaggcgcaaagcaatgtttatgtgtacgccacgaatccaacgactaaggcttatttctaccgcgtcatccgtgttcagactgccaaaactactgcctcttcaactaagaagacgactaacaagacaaccacgactaagaaagtggcaactaaatcgacggcggccacttcgtcatccaagaagacgactaaatcgtttaaagtcaacgcgccagcgggtacttggaagtcgaatacgactaacaagtactcccaaatcttaacgtttagcgctaagaatggatttaatcagacgctttataagaatggcaaacaagttaaaaagctggtctcgtatgcgagttatagcatgactgccaagacgccaacgttctggaaagtcagctataagtcaggctcgactactaagaccctatatttacgctatacagcaactaataagtttacggtcgttaatgctaaaaatcagatcgttaaagttaaggttggcaatgccccagcagctgtttggacgtttaccaagaagtgacgggtcgttaaatatcttaagtacgaacaattcctcggtattttggggaattgttttttgttgcttgctgatcaattagattgaacgtggcctagtgaatattaaaataattgaaaaaacgcagatagcttatcgtcattagcaggttaggtgagcgcatataaattggccaatttgggctgttcatagtgaccatgatggaaaaggcactacagcgttggtaagccatctagttcgctcgaaaaatgacttggtcgtgagtcacttcaaaaatgaccatcgtgcagttgtatccatgaagaatactgaataaacaagtaaatgaaaatgggtgttcgttagctgatacttatcatttaattacggttattaacacaaataaactatcacggtgataaaaatttaatattcggatatctgtaaaattgtaagtctttttctgaacgtcacaaactgaaaataatgtaagataattaacgtcaagagatgttaaaatactatctatgtgaagggagcgataggcatgcaacaccggcaattatggtatcggggcggcctaggactggcattagcactagttgtggtcggatatcgtggatcacggacagttattcgggcggttccccgcgcacaattgagtgttgatcagaaaatgccatcgactagcagtgttttttctgcttcgaaattgacgttgcaagatgaggcaaacaactcggcaccacaagtgtcacctgaggcccaggaaagttcgggacctgacaagcagtcggatttaacatcaggcagtagtaccagtagcagtggtatcagtagtggcaatagcagtggtatcagtagtggcaatagcagtggtagtacaatactggaaaacactaaaaataaatcaaacatcagaaacggcgacgaccaaagcggcagaaatggtcaatgggacggttaaaatgaccttagatactaatggcacattgcatttgagtggtgggtcatttggtgcatcgctagggtcagccacggggagttggattgtaaaaaccttgacggctaacggctatcaaccgacccaagtttcaaagatcgtcatcgacggtaagataacggcaactactatgactaattattcatatctgtttgctaacttacctaatgttacggcgattgatgggctagccaaccttaatttaactggcgtaacggatatctcgtggctatttttgaactgttcacagttaggcgcgttggacttgaatagttgggatgtcagcagcgtcatcagaatggagggaacgtttcaaaattgtgccaagttagttacgttgaatgttgccaattggaacacggattcattacagtatctaattgacactttcaatggtgacagttcccattaacgtcgttaccagttggcaagtggaataccagtaaagtggcgacgatgatgcgaacatttacggattgttcttcgctgacgtcattagacatcgctaattgggacacccgtgtcgtaacgaacatgtccgcgatttttagaggaatgtcgaaggttaagagtttacccattgataagtggcaaacgggccgcgtggttaatatgcagttagtcttttcaggtgatactagcttggaaagtattaacgtcgctaattgggatacgagtcgggccactgcgttggatgggacttttgctaagcttcctaatatcaagtccccgccactcgacaactggaatacaagtaacgttcaaacgatacggagcacgttttatggcgatactaacttgacccagctgccgattgacaactggaatgtcggcaaagtctttgattttaattcaaccttcagtggctgtaccagtttaacaactgcaccggttgcgaattggaaacacccagagtgccaccaatcttggttatacttttgagggcatgactagtctcacctcgttaccagtagataattggcagactggtactgtcacgaatatggccggaactttttctggagttagtcagttaaagagtctcccgattagtaagtggaatacgaagaatgtacaaaatatggcggggactttttctgaaatgagtagtgtcacggcattaccagtagataattggcagactggtaatgtgacgacaatgaggggaatctttaccaaagttagccaagttaagaatttgccagttggtaagtggaatacggcgaaggtcgttgacatgggacaagtattttacggcaaccccagttaactagtctgcccattgaaaactggaatacaagttcagccacggatttttcacagctatttgcggaagattcgggtttacaaaccttgagtctaggtgcttggaatacgaccaaagtgactaactttgaatcagtttttccaaaataccagtctagacaaattagatttgactggctggaataccaacagtgcgcaaacttataccaacgctttcagttcgaagttgccgcctaaacgtctattgttgggccccagttttaactttttaagagtgaaagttggcacttgccaaatcctagtagtgaggcaccttatattgggaaatggcgtagtttaaataataaaaagtttatacgtcagctgatttgatgactaaatacgatggcaaaaccattgttggagaattcgaatgggccactggcaacacgattacagtgaagtatgtggatgctgctggcaagtccttggcacccgacacgaaaatcagtggtgcaactggtgatgcctatcatattaaaccaattgagattcaagggtacgtgccagatcaaccagatggggttcaagggaattttaccgacaaagatgaaacgattacattaatgtacagtcctggaggactaatgtttgcctctagcaccgcagaccattaattttggtcagaatccgattactggtaaatcagaaaattacggtgcctcctatgatactgggctagttattcaagatggccggtcaataggttcaacgtggtcgctcaatgcaacgctctcagcatcaggcttcactagtaagcagtcggcacgaccattagcggctgtgctcagttataaggatcaacaaacgggtggcgagtcaattcttacgccaggtgtggcacggttgatcgtcaataaccatcaaactgtttcgaaccaaggcgtcaatatcctcggtcagaaaacggcacttggggcattatcgttacaagtgccaaccgatcgtgccttgacggatacgtatcaggcgacggtcacttggacgcttaatcaaggggttcctaatcgatgatgaaaaaaataatggttaggtaacataaaatttgtaagactgcttgattgttgttagtaagttagttatgtatatttacaactgtgtaccacaataactgttctagcttaatgattggtttcggccagggttggttttagttatgccgcaaataatgatatagaggaggagtggtgttgatgaagcgtttggggttcatcacaattgccatcagtaccctactttgttgggggtggttgtcagcaccgattattggtgtggctagtacggctgagagcccagcaacgattcgtttcgacggccaggctgagtcatcgaactcagacactggcgctaatcagttacaggtgactgaagcgtcaaagtcgagtcattcgattgtgcatcagccgaatgctagtcaagctgttcatcatcagaacccggggtggttaccacaaacgagtgaacaatggtggctgagtgctttcattggtggtattgggttattggtcgttttaattggttggcaattggttaactatctaaaaaaaggagttcattatcatgaaaaaaacattattaggacttttattctcagcagcgattgattgcaacatcaggtttgaccgcgagtgcggccgatacgccacaaacgtctaatgggacagttggtttcactgggggcgacatcactattgataatggtgatacggacttagctggtgctagtcttgactttggtaccaaccaaatcaccgcagctaacaaagacgataactatgacaacacgaataagtcagcagcggtatccgttgtggacttacggggaacggctgctggttgggatttacgtgtgaagcaaaatgacgtttttaaaaacgacaaagcggttgctaataaagaattgacgggtgcgattctaacattgaatggtgttttggattcaaatgcatcgacgactggtgcggacgcaacggccaataccggtgttgcgctagatacactcaatagtgacaaggttttgatgaccgccgctgtgggtaaggggaatggtaagaacgtggctgatattgctaagtcacaactaatggttcccaagactacggcacgagctacgggaagttatagtacaacgttaacttggagcttgaatactgcaccagcgaatagctaataagtattgatcggaaaaataatggctagtaggggttaatgtcatttttccgaatcatgattaggggagaaatgatgttaacaaagagatggtggcagttaggaattggtttgctagtcggattagttagtctaagctggggacgaacgggttcggctaacacagtcggttttgaggtcgcaccggtggcttccaaatatcaaatcgataaggctgtttcatactatgatctgaaactaaagcctagccaaacaaccactttggtagtgaaagtgacgaacacaagtactcaggaaatcaccgtgcatacggcaattgtaccggcgacaactaatcccaatggggtggttgagtatcaggcaacggctgatggcaagaacattgatttgccagctgatgctagtcaactgattacgacggcggcgaaataagattacccttgctaagggaaccagtaagatcgtgacttttaaggtgaaaatgccggctcagaagtatgatggtgttgtcgttggtggactgagtttcttaaaaaggccgccaaacaacagagtaagagcgcaatggcgattaagaatcaatacgcttactcagtggcggtcgtattgcatggtgaccacgcgctcaccaagaacaagttgacattgggtaagattgatgcgacgcaaaataacgggtataaccaaattagtttacccctacaaaatcgaacggccgctttcttgaatcaagtcaaaactgatgtccaaatctatcgtcgtggtagtaacaaagtgcgctacaagcgggtcaatgaacacggtcaaatggcgcctaattcagtttatgccttaccgttacgggttggccgggatgcgttgaaacccggccaatataccgctaagttggccgtgacgtccaaaaagcaacattggacgttcaccaaaggaattttgaaatcacgcgtgatcgtgcgaaccaactcaacaaaaccgccgtgattgaacatcatactaactggggttgtggatcagcctcggtctgctagtcatcttgttgttactgattgcttggtacattcatcgcaagcagctaaagatcaagcgattagaagaacggcttaaagataaatcataaattcatagccattagtactgttataaacggactcggtcaggttggccgagtctttttgtgggttcggtggcaatgaatataaatttacctttgctaacttaatcattatctttttgggcaatgcgcagcggcttgtttctaagtataatgaaagtgtagttaacttaaaggacgtgaatgaagatgaagtatgaatggcgtaaacaagaaaaacaacctatgctactaagaagcaaccccaactgttgacgattccagcccaaacttttatgagtatccatggaacggggaatcccaatggcccagagttttgcttgcagacgcacaccgcaaacgttatatccagctgcttatgggctcaagcatgcgtataagcagtatgcgcaaacacaggcgtgtgaatttgatgattacgttgtttttccgcttgaaggggtctggtcactgacgactaagggacagcaatttgaccatcttgacaaagatgagttcagttatgacattatgattcgggtcccagactttgttcccactgaactgattgcaccggctttggcagcggttaaagctaagaaacaactgccaactgaacaaattaacgtgcagcagttcgacgcaatgcaagtggcacagattctgcacgtgggtgcttatgacgatgaacccgcgagttttgccaagatagatgaactggtcgccaatcagggtatgcatcgtactagcaagattcatcgagaaatttatttatccgatgcacggcgggtggcacctgataaactgaaaaccattctccgatatcgagtggcgtcgaattaatcatgcgaaaacttttgactggcattgggcgtgaagcacgaatataatttaattatattttaactcatataaaattataattaaggggtgctgatagtatgacgcaaatagagattagtgatcggctgaaagctttattggttgcgaagggctttgataagaagcaattggttttggtgacggatgatggtggtggcaagtactctttgcacgggggtgcttgcagtattggaactaaatttacgataatcgtacttgaccagccggaccccgaatacaacgtaacggtggtgaatgatcaaggcctcgcgctttggacctccacatacgatctcattttctttaacgatggtattaagatggattacgatcaggggcggatcgctattaaggacaatgctcatatgctggacaatgccgttcaaatcgctaaaggagcggaagttttagctgcttttgaacagggcgtcccagccgataacctaacttgttaattgcgatatagaagaaggcataataatgaaggcagttatttttgacgattttggtagtcccgatgtattgcgcattgctgacgtgcaacggccggtggcgacaactgcgaccgtcttagtgaaggtcatggcggtggccgttaatcatgttgatacgtttgttcggagtggtacgtttaagacggccctggcagcaccacacgtggcgggacgtgatttagtcggtgaggtcgtagccagttcgcaaccggactttcaaattggcgaccaagtctggacgaactcaatgggctatgaaggccgaatgggcgcaacggccgagtatgtggcggtgccaactgatcgcttgtatcacgttcctgatggcgtggcgcccatgccactcgtcgcggcggtccattcagctgcaacagccgccatcgtacttaacgacgtcatggaaatttgtagtggccagacactcctaattgaaggtgccgcgggcaacgttggccgcaagctgattcaaccttgcgcatcaaatgggcgtgacggttgtgataaccgcatcaccacgagattttgcacggtgtcagcagctaggcagtaccgcctgttatgattatcacgcggggtttgcggaccagttaacgacggatcagtggacttttgaccatgtgatcgatacctcgggacgcgtaccactggcgattaatttagcgttattacgattgggtggtcaggtgacattgattacggcaccgcagataaccaatttgagttccctgttcgccagttttacatgtctcaacagcgaatcactggttttgtgattagccatgcaacggttgaccagttagcacaagcggccagtcgtttaaaccgagcttttagcgccggactgctattggatgatcaggtcagccagcgatattttaaggatgccgctcagtgtcacgctcaattggaagcaggcacggatcatcaccagcgctttgtgttattaccgagttgattcagcataacgatttggaaagcctgattaattaatcagtaatactatgtcaacaatagtattgtaattttggtgatttaaagtgattacttggcgggaggactggacagtcggctcccgcgcgtctaaagttgcgaccaatattatctgtgaaaggaccggcgtgctaacaatccgaaaggtgatcgatacggcgatctttactaatgttaatggcattcctccgtggtaatacgcagacttgaaaagaatatcgatgacgaaagtccaacacttgtcagcaagggttggactttttgtggtgcagcaccagaagcaatggcagaaaaataattaatttactacctatactagattgttgatatgaatttatttattcggatagtcatcgattgttggtgaacggctttaaaggaagttcgcttaattatctcaagcaacccacgctggataacggttacacgaacaatccgggtttgtaaatatagttaacattatacattattagcgctgttatactgactgaccaaccaatataatgaaaatgtggtcaaaggagtcggcatttaaattaattaatcaatcgtacaaggttattggggaggtcacaagtgatttagtgccagtaatttatgaattgttatgagagcaatcattgttgataatgaccaccgttcttagttgatgaaagctaaacaagcgctggtaaatgaaaaaggggatttataccatgaagccaatgttaggacacttattaatggcgggaactttattattagcgggtagtacaccgattgttgccaatgctgcagaaaatcgtagtgggaatacggatatcaaagcggaatttacgaagagtacgtccacggtgacgccagttgatccatcaaatcctgatgtgccaagtactgatggcgatggtgacaacggggcggcagcggtggcgacctgtcgctgatttttgtgtctaaatcgttaggatacgggacacatgagctggacgttttaaatgatcaacaatatataaggttgacccaactagttcatatactttgctatggcaggataagatggttgtagaagtttctgatgttcggggaaccaatgccggctggaaattaacggttaccggctccaatttaacaggaacggatggtacggctgcaaagggcgcaacgctcagtttaccaaaaggtgatgtggtcaacagcggctcggaggccaatggtgcggttgccacggcttccgaagttgctttaaatggtacggtgggatcaagtgccgtcttaaatgccgataagggcggtggttctggggtaactgttagtcgcttagatccaaaggcgttgacactgaatattaaggctaatacggttaaggcgcaggcctatagcgctaacctgaattggacattgagtgatttaccaacaaattaagcgtcatcggggcgaacggcgccccaagtacatatgtgagtaatgggggcgagaagatgcaattattgaagcgaatcatggttattgtggggacgttaattttaggcgcaagttagcagcgttagtggattggcagccagtaacgcaagtagcagtagcagtaaaaccacgcaaagcaatgacatcgggtttagcgtggccgcgaagattccgaataatcagattgatcaacataattcctattttgatttaaaaatgacgcgtggccgacagcaacagattcagacgacgatttataacgttactaacgctgatatcaaggttcaaacggcgattcatacggcttatacgaacggcaatggcattatcgagtacgtgacaccaactaaaagttatgatccttctttgaagtatcgaatggaccaaatcaccaaaatacagggaccaacgaccatcacgatacccgcaaacgggtcgaaagtggtaacggcgacggttacgatgcctaagcaagcggtgaacggtgtgattttaggcggctggtattttaaacgggtcgccaataaagtcaccggaagtgttaaagggttccatgaatattgccaatcagtattcgtatgtgattggactgaaatatactgctggtatagtgccacaaccacaattgaagctcgatacgattacggcgggcatgcagaattatcggcgaggggtgtttccacaattacgcaacgttactgcggtgatcgtccccaaactaacgattacggctaggttaacgagtaagaatagtggcaaggtcatcaagaactttacacagaagaatgtgcaattagcacctaactcagtttataaagtaccaattttgacagggaccaatcgtttgcgggctggttcgtatcatgtccggctagttgctaaaaataccgatcatcgatgggtgtttgataaagattttgtcatcagtacggccgcggcagataagtataatcaggcttccgttgatgattcgggaatgagcgttggctggtttattctattcggagcgttaggcatgttaattattggattaatcggtctattaatctttttctggatcaaaaagcggcggcgtgcttagttcggtcagtgaaatggggaaggaccatgccgaataaatggtggcgattaatattaggggtaatgctcgtgctgagctgggcaataccagtgcgggcggcaacacacggtcgcactgagatcagtgtggggttttatgagactaagtatagtgctgaccggattattcccgcccgtgtgattcctgatggtggtcacccgtacgttattagaccagctgacccgggtacccagggtcagagaaatcagtcagagcgcaagccaatccgccgacaactaattatcgatggctggttgcgtgggcaatcacgcaatggtcaacaattgccccaaacgagcgagcggcttgtcattggcagtatccttggtgggatggggttgttagctagtgttttagcaggcgcgttgtaccgaatattaaaacggcaagatgggggtgaacggaatgcgtaacagacgaagtaaaatggttactaattcttgtattcggtatactcggcttgctgaatttgctgcccttagagggtaacgccgcgactttgacgagcaagatgacggacgtgaaagctaatgctgcttttcaggccgtaccgggtggtaattcggttggtagtaatgttgataacggtttgcaagcgtatccagcattaggcaatgtgtccgctaactatgcggataatggtcgaattacgaggcagacgacccaaattacaatgacgatgacgggttcgattaccttaaaatctagtaactcgatgtcaaaagcttattttgatattatggctggtccggcaagtgggagctacaccggggcgacattagttacggctacacctactagtcttggcagtggcaattcgattatgattagttcttcaaaacagacgcagacgttatcggtcaattttcaaaatattaaaagtgagttgccaatctatattggcttccgaatcacagtgaaatggtgaggaaggtacctatcagctggggcgtttcaacgcgcagacattatctcctaaaattacggggacactttattcgactgatacgacgatcaaaggaaccgggacacccggcaatacgatcagtagtaatgttaatggtgtgacgacgacggtcggaagcgatggaacgtacacgctgaatcttgggactgcactcggtactttaagtaacgtcaccgtcactgaggtcgatgagattaccggtgataaggggacggcgaccgcagcggtgaccctcaaaaaactaaatattactagttcaaagacgtcagtcgatctatatcctggtgacttagattcactgacaagtgatagcgcggtcgtcgcctggttagttaagcaagctggcatcgttgcgacaaatccggatagtgcgactgacacaattacttacgcggccaacgagactagtttagcgagcaagttgagtagtttagccgttggtagcagcaccacgatcaatatttatggaaaaggcagttctgggctgaagtcggatgctaaggcaattactgtgacgatgcgggatggaacgttgagtctgggcacattaccagcaagtttgacgtttggcaccctgacgattccgtttaaagaaacactatatcagccgacaaatgcttggaacatcactgttaatgacacacggaagaccggttcacagtggtacttacgggcgacagcaactgccatgaaatccagtacgcggaccatgagtggcaacctgatttatctgaacgcggggaacaaacaggtgctgacgaatacttcggtaacagtcagttctggcaagaaaatcgcgggtacgacgagcactaatgctgcaagtggttggtcgagcagtcagggtattttattggatgtccaacctagtgtgcaaattgacagttacagtgggacgattaattggaccttacaggatacaccttaaaaattaatataagtggttaaaagatattgcaaaagtatgtcgatttgcaatgtcttttttatgaataattaataataagattgtaagggctttattatagtttaatgcaaatttatgtttacaatatagagtaaagggtttaatgaagccgtatttctgatatagtaaagtgaactaacaaatgtattaatatgatgaggtggttggcgtgtcagcagtacttttagcgctgtcgttgatttctggcggttatgaaatgttgtttttaatgattggttttagagaatatgtcacttggcggattgccatcatttggctaagtctggttatcattacgatgagcctggggaagtggcttcaaacttatggccccaagtcccctggcttatttttggatcatcccgattgtttgtgtgaccacctttatgagttctcggttgttgtacacccaggggattttaatgttaccggtggcaatctttttgaatgcgcttaagcgattagtaggggcaatcatgggtgtcattgttgccaaggctgtagcccaatctgcatcgccaatgttattacggcaagcgataggtctacattcgacagcggatattaatctctttttagcgtcgattatgatgctgccggtcattattattttagggatgttagcgcatcgctggttagtacaagtgtcggccgccgatttttgcaacgggcgcgtgttaatattagcgattacttattagttattttgtttttgctatttacattattgcgtatgtttttgcgatggaatggtcagtcaatgcgcaaacgtatatggcaattgcggctatcgtgacgtttggcattatcgggtcgtatttaattagtaataaaaacagtcacttgaatgatgcgcagctattgctacaagtctcaaattacaacgaattattaagccaccataatcgtgacttacatttgtttaaacatgattatgagaatattcttttgagcatgtcggcatttattcagaacaatgatatggccgggccttaaagcgttattttacaacggaagtaatgcacgccagagtaacccttaatcgtcagtcgggactgagtgatttgagtcgcttggatatgccgacggtcagtggtctaatttatgcaaaatatgaggcagccaacggtcagaacgttcatttagtggtgacaatcttagagaaagtcacgttagcggatattccacagataaaagtagtgcggattttgggtaacttgctggataatgcgacggatgctgctgcccgagcgaatcatcaagtggcgctaactgttaaaaatcgggatgctcacacaacggtattttcgattacaaatcaaattccaacgcatgaagcggtagatttatcagttatcaagaaaagtcgatttacaactaaaccaggacatttgggttatggattgagtagtattgaacaattaactacagatcaattagttgttaattattgtattgaagagggcaactttattgcagagctcattatcaaaacattaaactatgattatgaatcgaaaggatctgaatttggtggcattactaacaacattacctaatattgggccaacattagccaaacaattgcaagccgttgcgattacgacacccgaacagctaaagtcaacgggtagcaaagtcgcttttactgccataaaaaggccaaccccacgcttgtattcaattattgtattcgttacaaggcgcaattgagaattgcgcttacccacagttatcaccggcaactcgcgaagatttaaaacaattttttagatcattgctataactcatgaatggcaatgtgagcgctggtcggagaatttaacgataagcttttagataattaagaccatacttttttcactttatgtgaattggttaacataaaaatgattgctttaaagcggttatcccagattacgaggaataaccgcttttgtgtattgattgttaaataaaaaatatttgttagaatcattagtgtacagcgggattagttagcattgtaaattgtcagatggcaaatgtaaatagtattactgctagacatctgttaaaatgagcattatttttgggttaacaaattttgaccaataacgtaaaggagttacagattatggggacagaactacaatttgtacaatatttacatcaaatgcgtgattataatgatcagcacccaaccaccaaggggctgatcttattaggttacttagaacgagattttattcgattctaccgggccggaaagattgaagaaggcattcaatttgctaagaagaatctgacccgttcgcgcgatttattaaataaattatcgagtgaggaaaaacagctgcaactcagtgcgctggttgatgtcttagcttttgagggaatccaaaatcatgctgagatttatgaatttgttaagctacgtaatgattatcaccgttggttagttaaattacccgtgacgacggaacgttaccagccactagttgtgcaggattattcgtgattttgccgcaattgccaaaccgaacgcattagcttataacgcacatttagagtcaacgctcgatgtgatgtactataccaatgctcaccgcatgatcaattatcggtgaaaaaggtattggcccacgtcaatgcgcggtgcaatcctgagtcagtgcggcggtcgtttagtcaagagatgcatatgtcgattcgtgattacatcaatgccaagaaaattcaggaagctgagcatatgttgttggcaacggatttaaccattcgagccattgctgctgaactctgtttctacgatgccgccgatttttcaaaacgattcaagaaggagaccggtcaaacgcccttagaatttcgacaacttaatacacgaactgattagtacttgtatttttaaagataacctttttcgcgtaaatacaaacccccgttttactcgcataaaagcgggtatactatgtctcaaaattcaaaatatgtcgatatttgactaaaaaattaacagaggcaaattactatgcgatatacacggggcaaatggcgcgtaaccaatcccaaggtttggttgttttctagtgttttaattttaggttggagaattgtgccgacagtggctcaagcaagtgaagctgagacggttaccatgtcgagtcattcggtgcagttagaaacggataatcaagaccaattaacagaagtagcacggatttcaaaaactgcggtaactcgtgatagccacagtgtgaccgcccagtccagcaagtcagctgacaggactagttcggagcaacctgctacgactggcactgttgaggcggtcagtccaacgactagtgaagcccaacagcggtcaacacagcaagataaaacagctgttgatcaacaggcaagtgactcaacagcagcttctgcgggtgccagtactaatcaggcgtcagccgcaacaagttctgatcaggcgccagcagccaactcaactggcactcatcatgcgattgatatggccagttcagctagcgcactaggtgctgacagtggggcccattctgaaagtttatctgaggcgcaacactcaggcggtcaaggtaagacgatcgattcagatttatcggggactgttcattcacagtcatcagtgagtactgtgacgacagctacccctgtgaactcaaattcaagcctagaaagcgacaagtttacttccacacggagccgagctgtagcggtaactgatcaaatgagcagcggggttgagaaaagggcattgaataaaacaaatgtcactaagtcaataaacataccagttgcaacaaagcagccgagcaagcaacggacagtcaccgcttcgtcgtttttgacaacagcaaagaacttagccgataagaactatcttgatcagtatgccaaacagcatgggcaagcggctttgattgctttgatccaagattggttgtccacgtatcgaattattgcacttacaggaattacgattgtgcaaatagttcgtttgatggtagtgtggctacgattagtggtggtctgcacgttatcaatacgggggcgacaattcgttctggccaggatgatgaatgggagaccatcataaacggtggtttgtcagtgacaaacaatacaatcacgtttacaactaccaatggattggtggaccgtcccgtagctaatcaggatatggattttacaaagcctcggccaacgggaaatggtgcaatcaaaggtttaccaagcgttacggttgattcttcgttaatcaatgcgcaagaatttagtcaagctcagatcaatattagtgacttttatgatcaactagttactgcggggactattttatcggcaactaatggtggcacgttgagtaagatgctgattggtgagtctggaactgctgatttgggctcttatcaaggacaccattattatgccgtgaatattgatttgaatgactggcacagtggtattcggaccactggttttaataagtgatgatgtggttatttataacgtcgtcacggcagcaccagcgttaaccattggtggcggtttttctagtagtacaccgaatctagtctggaacttcaatcatgccatgcgtattcagaataccacgatgataactggtaaaatcgtggcaccacatgctgtctttacaactaatcaaaatgttgattcagcggccgttttacaatatggatatggcgatggtgacagtgttattcgagagacgattacgagccaaaacgagcataattatggttttggtcaagtggttactgatgacccgttggattacttaattgcagtgattaagtcggatggtacgagcattgatactttagctggttttcgccatctactagcaaccgggcaactgaagatcacgattacagatgcggctgggacacgtttatcagggttgaatgcagttgatacacatattgcgggccagcatcgctatctaatcacttaccaatttggcgatcaaactgcaacgacttggttgaacgtccaaccatcgcatgagcccataatacctatcagccggataccggaatattcagcgataacgcggacgatcaattaccaagatgagcgaactggggcggtgcttgctggcctagttatacaaaatgtacgggtcgtgcgatttgccatttttaatgctaaaactcatgaattgctcggctatgatacaaacggcgacggaattgttgatactagtgatgggacaattgcatggctgttagtaccgccaacggatcaagattgggtacaggttgtctcaccagacttatctgcgcggggttatcaagctcctgatattccggtagttgcggggcaaacagtgatcattaatggtggtgatagaacgatgaatacaaatgtaattgtcaagtatcagcaacaaacgcatattgcaacgacgcagcgaacggttacccggacgattaactatatcgatggtggaacactgcaacccatcgcgtcactacatgctgttgttcaaacggttaagtatcaattattagctgtggttgctcatgacggaacgatacttggctacgataccaacggggacggacagattgagacacaattggcagatgaagcatggttgattgttggttcagggccgtggtttggcgcggttaagtcgccagatctgagccatgagggctacgcagcgccggacctaaaagtagtgccggagcagatggttgctggggtcgatgataaagatgttacgatcaatgtttattaccgactagcaactcaggccgttacggtgtatcaaaataaacggcgcgttatcagctatattgatcgacagacccatcaatcgattgccacgaccgtccagcaattggttatttaccaacgaacagcaattattgaaaaaaagactggcaaatgtttaggctatgatttaaacggtgatggattagttgatacgagtcaagctgattatgcgtggatttctagttagttggcagtggtcaatttgccgcggtaacgtcaccaacgctagtcgtccaaggctatactgatccggacataaggactgtagcggctcaaacggtcgcgattactgatccggacctgatgacgacaatcgtgacttatgaccatcgtattattacggtaacaccaggcaatctgctcgaccaggacagccagttgatcctgacaatccgaatatcttgtttccagatgagggtggcgacaccgatttaacgcacaccgttactagaatcattcactatgtttatgaggatggcacgacagccgcagcctcggtcctacaaaccgtccaatttcaacgcaatgcgatgattgatttagtgacgggcgaagtgacataccaagaatgggtaccagtctcggtaacggaaatggcgggcgttatttcaccaattgtagcgggtgccacgaccacattaacagaagtggcagcccagcggtgagtgtcacaactgccgatcaggttgtagtggttacttacaagaaatcggcaatcaaaccggaagaaccgggtcaacctgagcaaccaagtcaaccggaaaaaccggggcatcctgagcaaccaagtcaaccggaagaaccggggcaccctgagcaaccaagtcaaccagaagaaccggggcaccctgagcaaccaagtcaaccagaagagccggggcaacacgagcaaccgagtcaaccggaagaaccgggtcaatccgaaaaaccaggggaactgcaaaaaccgagtcagccagctgattctgagcaaccagatggattaagtgatcaagccaatttgagtcgtaatcaggctgaacaatcacggacgtcacagccatcacaagcagagtcagatcaaagcgttgtgcagacgaatcagcagaaaacagctgcgtccgtttcaggtattggttgggttagtgcaccggcggtatcaaaacgtaccactaagcatcatcggatgacgacccttcccccccagacggacgagcagaatacgcaattatcactcttggggatgattggattagcattgagttcaattttaggttggctgaagattaagtcccgcgattaacagttgtgagatgatacccgttgtgagttgcggatctttaggaaccgggattgacggggttaatgttcctttgagggacagctagttttgaatgattaatataggcaatcactgacgtttcttattaaacggtagtgattgccttttatggtatcgtcgttggtacttttgatgcggtcagttgaccggtcaaaatggcgactaataactgagcaaaggaacacacgcggcacttttcgtagtgacactaaatgtcagacatatgatagtagcaactgggtggagcgtttaaaaaattaagggttatgcctaaaaataacatttatcgttgacaattgtaaacgaagggattaatatacacatatagattacaagtgtaaacgataatgagaaagggacgaatataaaatgatgattaaagtattagtcttattaattggtgggttagcaattgggtttattctgtggtggttcttcgggaagcatgctacgacaacggtcaccgcgagtgcggttgatgatttacagcaggttgatgtggaggttaagggtggctattcgccagagcaaatcgtgttgaaaaaggggttccggcggtacttaattttacgcgcaaagatgcatctggttgtctggatcacgtggtgttcagtgatttcggtatcaatcaggaattgccacaaaatcaagttgaagcaattacgattgatacgagtaagtctggcgaatatcaatgggcctgtgggatggacatgtttcatggaaaattaatcattaaatagtgggaggaaaatcaaatgagcgcacgacaacaaatcaatattacagtagacggccattatgacccagcagaagtaacgttacaacaaggtgtaccggcccaattaacgtttacgcgcaccgagtacgcgaggggtgcttagagcaagtacattcaaccgacttgcactttacgactgagttaccccttgaccaaccgcaaacggtgacggtaccaactgatcgagccggtgaatttcactttagttgtgggatggacatggtgagtggcaaggtggtgattgcgtgatgagcacgacgaaacggttttggatttcattaatattttccccgccactactggctaatatgattttgatgccctttggctggatgcttccgggtggtgattggacgcagttgattctgacgaccattattatggctgtttcggctcggccgttcttgcaaagtgcgtgggcgtcctttactaagcaccatgccaatatggatactttggtggcgattggtaccgcgacggcttatttttacagtttatacgcaatggcaacgggacaagcagtcttctttgaaagtgccgcacttgtgaccactttcgttttgctcggccaagtctttgaagaacgaatgcggcacaacgcgtccagcgcggtcgcaaagctagtgggcttacaagccaaggaagcggaagtgttacgcgatcaagaatttgtaaaagtgccgttggatcaagtagtggtcggcgacattattcgggtcaagccaggcgaaaaaattcccgttgatggtgtaattacaactggccgctcaacggttgatgagtcaatggtgacgggagaaagtatgccggttcaaaaaacggtggcggacgctgtcattggttcaacgattaatagtaatgggacctttcagttcaaagctagcaaggtcggtgaccagacaatgctggctcaaatcgttgagctcgttaaaaagcacaaaacagtcacgcaccgattcaaaagctgaccgataaagtttctgatatctttgtgccgattgtgctaattattgctatcgttaccttcttgacctggtatgttttcttgaatgctagtctcgcgaatgccttgatttttgctcggtcgctgtggtcgtgattgcctgcccgtgtgcgctaggtttagctacgccgaccgcactaatggtcggtaccggccgtggtgccaagatggggatcctgattaaaaatggtgaggtcttggaagctgtcaatgacgttaaaacggtgatctttgataagacgggaacgattacggttggtcacccacaagtgaccgatgttatcggcgacgaagcccaagtactgcgcgttgccactagcttagaggcggcttcggaacatcctttagctgcggcaatattaaaacgcggcacggcccgtggtattcaagcaccaaccgccacgaacttccaagccatcgagggtaaaggtgtgactgctcaagttgagggcaaattagcggtggtcggtaatcataaattattaactgatgagccgattagtgctgaattacaacgccaagccactgagcttcaggacgcggcgaaaacggtcgtgtacgtgggcttaaatcacgaaatcattggattgattgccattcaagacgtcgccaaatcgacgtctgaggtagccattgcgagtttgaaagcacgtggcttgaagacggtcatgttaaccggcgataacgaacgggtcgcacaagctgtggcggatcaagtcggtattgatgaagtgattgctgatgtgctgccaggtgataaggctgagcacgttcacgcgttccagaaggctggcaaggtggcctttgtcggcgatggtattaatgacgcccccgcgttgacgacggcggatgttgggattgctatgggttccggaactgatattgcaatcgatgctggtggcatcgtgctcgttaagaacgatctgcgtgatgttgaccgggcgttggcattgagtaagaagacgtttaaccgtatcaaacttaatctgttctgggctttcgtgtacaacgtgctcggaattccagtcgcggcgggcctcttctttgccattgggctgacgcttagccccgaattggcccggattagcaatggcctttagttcattgtccgtagtcacgagttcggtattgctaaataaagctaagatcagttcgaacgcccaacctgcgtagacgatgagcagatagcgtcggatgaaatcgggcttgttaaacaagcagaaatgtgtgttaatggtacaaaatatgcgggtgtctaacgccagttcacgttgttgagctggcgttagacacccgctttttgagtcgacaatttaaggaagaaaactggctataaattcctcacaatcagtaaaaaaagagtattagatttacactaattaagtatcatatcgttagtgtaaaattagaagaatgcccatttaacggagataagtgtggtgttagatgcttttgtaagcgcttgaatcaaattgtgtattgtgtaacaatattaattgtaagcggtttacatactatttgaaacgagggtttgaacatgaaaattaaagcagcagtggttgataaagtaaacgatccatttgtcattaaagatgatattgaattagctgaaatgaaagcaactgatttacaaatcaaaatggttgcgactggaatttgccattctgatgaagcaattcggcggggtgatgcgtcgttaggttatccagtaattttaggacacgaaggttctggaatcgtcgaaaaggtcggttcagaagtaactaattttgaagtgggcgaccatgttattctatcattttacgctgacggaacatgtgataactgtctgaaaggcatgccaactaaatgtcggaattatgccgactataacttgagtgggactcgtcccgatggttccgaccatttccaagaaaacgggcaccatatcagtgatatgttcgaccaatcttccttcacgactcatacggtagttgaccaacgtaatgcggttaaagtaccaaaagaactagatttacgtcgcttgggacctttgggctgtggctacgtcaccgggagtggcactgttttgaacagtttacagccgcgcccaggacaaacaattgcagtctttgggactggtgcggttggtttagcggcaatgatggctggtaagatttctggctgtaccgaagtgattgcggtcgacattgttgattcacggctagaactcgccaaagaattaggtgctactcacgccattaacagtaaggaagaagatccagttgaagcaatcaagaagttgacgcatggttacggggtcgactttgccgttgatacgactggggtagaaccagttatggtttctgcaatccacgcacttgctcaaggtgggactgctgctttgattgccgttacagccaaaaatatcaccattagctcatggaacgatttgtgtgttgatgataagaaagtcattggtgttaacatgggtgatgccatccctggtgttgatattccacggttaatcgatttctatcaacatggcatgttcccatttgaaaagaccgaaaagttctataagtttgaggataattaatcaagctaatgctgattcaggtagcggcaagaccatcaaacctgtcttgatcattgatgaagattatcaaccggggaaatagctgccggctgggtgccatcagtttatgatgaataacttctaaaacggcggtgtcaaaagttgattttgacatcgctgttttttgcgttaaacacaagccgcttggacggcttgcataatttgtgattaaaacgtgccggttcttaaattcaaaaacagccagctatggaccgctgggaaaaagttcgactcagcgtaaacttgtttagttagttcgtcctacaccgacttccaggcatttctgccaattgccggaacgtggtgggcacagatttaagccgaagcccacgtcttaaatactggcctttcactaaccaagccaaggacgcttgctaagtgaaatttcaccactgggcattggccgaaacgccttccagtcgggacagtgttcgaatggcggacatgtgcgtacaccaacttttggcgaattcgtcattgtttttcataaaccataattttgtcaatcaactgtcagggtgaaaatgatattgagatagctcactaattctgaatttgtgtagtaagatttaagctcttgacagagggcttaatacacctaacgctttgtttaaagttccagtatcaaatagcgaacaacaaattgtaccgagttcggtggtcgttcattagccatttgagcggcttcccgaaacgtgttcggggccactaaagcctgtgcttgctacgccaacggactaatgccaaaaccgcattaatccgttggctaggcaatgctcggcttcaactcgtggcccctcacactcttgagaccggaggggctgggtgacaatgctcagtagccaaattattcttagtcggaagtggggtacttccggcttagaataagactcgtatttgagatgacgcgggttgggcgttagctcaaatcgacgtcggctacgttccagcacaattgtcacccagccccggaggtcggaataggacgcgcaccggctgacgaacaggaatctacctaaccggcacgttttaatcacaaatcagaacaaattaatttgcacaatgcgtgttctgatagacattcttatctgtgcttgtcggtttattgttgcggtgtttattttgaatagcgcgtccaaacgtggggtgcatggcattgccgagtaacgattcgagttgtagagaggtcccaatcaaataatcggttcaagaatttactatgaattcttgaaccgattatttgctgtgaatgatttagttaactttgaatggggattacttggcatcatatgcggcttggaaaatcttgatgatgtcttctttagtacctttgcgtgggttagagaaggcgttaccgtctttaagcgcattagtcgccatgtgttcgaagtcctcgatcttggcgccaatttccttgatggaatgcggaatgccaacgtcttcgctgagttgttctcatcatcgctttgatagctaattcggcagcatcacgagtcgataagccatcagtgttttcgcccataattttggcgagctcggcgaaacgttcggggcacgcgattagattatattcttcaacgtagggtaagagcagcgcgcagcagacgccgtggggtgcgtcatattggccgccgagctggtgggccatggcgtgcacgtaacctagattggcgttgttaaaggccatgccggctaacatttcagcttcgaccatgtgtgtccgggcttctaggttatgcccattggcgacggcttcacgtaatgatgtttcgattaatttgatggcctggatgcactgtgaatcggtaatcggattgtgatcgacagaaacaaagggttcgatagcctggacaaaggcatccatgccagttgcggccgtgagtcccttaggaacatctagcatgagagtgggatcgttaaaggacacgagtggcatgttacgccatgaagcaacgacgaacttataatgcgtttcttcattcgtaatgacacagtgacgggtcaattcagaaccagtcccagcggtagtgttgaccgcaatcagtggtggtagggcgttcttgagcgtttcaatccccgctaacttagtgatgtcgtcgccgttagtcatgatgatgccggcaccttttccggtatcgtgggcagaaccaccgccaatggtaatcagggagtccgcttgattagcttgatataaggctttaacagcttgaatgttatgaattttagggttgggttcaacttgattataaattacgtagtcaatcccggcagcatccagtgaccgccgcacctgagcaacggcgccgtctggcagactttcaagaaatttgtcggtgacgatgactggcttgtgcataccaagagttttggcacgctcgccgattttactaatgacaccaggaccgaaaaagttaacgctaggcattaagaaatcaaaattacgttcagtcatattaaataacctctttttatattgtaatcgctatcattactaatttacgaatcaaattatagtcgtaataattacaatttgcaatactttttggctaattaattatgtttttcacaatatcgtttagaaaaggtgcggcgatcacggcacacctgttgtaaccaagtgttaaatgacggtgaactatagtcctcatgctattttatattactgcctacaaaaagacgactaattacaaagattcacaatcttagtaattagtcgtctttttagtgtgatccaatagaaaaattgggttagtaccagtgatgatgttgccagaaccgtttggccttgacccaggagccgtagcgcgaggcgacgtaggtattagcacgtttttcctgattgacgggtgacaagttgccgtgtaagtatgagcgcaacaattgatagcgaccgtagcagcggccattacgagccgtataactgtatccagattcacgataggcgatccaatttttgggcagcgcggttggctttcgaaagcttggcgttgatcttggcaatttgctgggcttggctaagcttcttggaggcctgggcggtgattgtggtttgtggtccaagactagtagtcacgttaacgacgaccccgaagacacaactagccaaaactaatagcaacatggttttaaagttaaattttttcatgatatgtataaccccgttttatattttccctaagctgataagtgtagaatacgccaattatgtgtcagttatgttaaagaaaagttactatgttattaaatgaacgtttccgttatgaaatagttgttgtcaataactgttgcggcaattgtttagatgaataattgcgctgactatcacatgaaaaaatcataatattgttaggaaaactaaagcgctttattgccttcgttcggtaatcttaaattggaatagctttacaaaagtattaaaggagtaagtgagggagtgcaataatggcaacaaaagataaatgaaaagattacattgatggcgttagtcatgatgatctttacgaccgttttcggatttgccaatagtacggtggcctattatttaatgggttacagctcgattctattttacctagtcgcagccgtactgttcttcatcccgttcgcgctaatgatggcagagttcggggcagcggttaagtctgatagtagcgggatgtacaagtggctggaagtgagtgtgaatgcgaaatttgcgttcgtgggcacgttcatgtggtttgcgtcgtacatcatttggttagtctcaacgtcagctaaagtctggattccgtttacgaccatcttctttgggagcgatcaaacgcagcgctttgcgatgtttggtctgaatgcgacgcagatgattgggattttgtcctgtctatggatggtgctagtgacgttcgtttccatcaaagggatgaaaggcattgtgcgggtcacaagtttaggcggcctggcggtgaccagtttgacgggcaatcctgttagtggtttcggggtcgttttagccttgaatcacggacaattcgcacaaccgttacaacatgtgatgacgtcaccaaatccaagttatcagcatccagtcgggttactcgggtttgccgttttcgccatttttgcttacggtgggctagaagttctcggtgggatggttgataagaccaagaaccccgaaaagaccttcccacgcggaattattatttctgccatcgttattaccttaggctatggcctgggaatcttctgctggggattagtacgaactggcaagccgttttgtcgaatccaacgactaacctcggcaatattagttacgtcatgatgcaaaacttgggctatgttttagggcaagcgtttggtttgagtacagcggccgctaagacaatgggactgtggtttgcacggtacaccggcttagggatgttcctcgcttacagtggggccttcttcaccttaacttattcaccattgaagaacgcttatcttgggaacacctaaggaactgtggccgaagaaatttacgaagctcaacaaagctggtatgccaagttatgccatgatggttcaatgtgccatcgtgattgtgatcatcttggtggcgtcctttgcaacggcagacgcgtcagccttttacaatgtgttgaccttgatggcgaacgtttcgatgacgttaccatacctcttcttgctatacgcgtttccgaagtttaaggaaaaccagaacattgttaagccttttgaagtgtacaagtcattgacttggacgaaaattattagttgggtcgtgttcattgtcgtcttaggtgcgaatgttttcacgttgatccagccaatcttggaaactgggcagattcaaaatacgatttggatgttagttggaccaattgtctttggtgtggccgggattatttggtatcaagttcgagaacggcatgtcaattaaataaccaatttcaaaataccattcgattgctgactgataaaacagcattgaatggtatttttaagtgccttaatatgggaaatttagtacactcattagcaaaagctatctagggggaatggtcatgacattgggaactgcgttaaagcaggcacgcaaagcccagcaactcaatcaaaagcaagctgcccggggaatttgtgcacaatcgatgctgtcagcaattgaaaatgatcgctacgtgccgaatgcccggctattactggcgctgtgtcagcgattaggggtcgcggttagtacgttgagcctagccgacgattttgagatcagtgccgagcaagcgtttaatgaccgcgttcggcagatgtgcaatgcccatcagtatcagcaattgaaggattggctattacagccaaccactttggaacatgttcaaacggatgagcagactcaggcttactattattatctgggtgtcgcctgttggcgggttgatcgcacatcggatgctgcacaacaaaatttacggctggcaattggtatggctgctcccagctcgccgccgacaacgttgacacgcttggccttgatttcgttagccgtcgttaaggcgcaccaccatcctcaagccccagtcgcggccttagtcacccgggcactcgctgacattgatgcgagtgcatatgaagaaaatgccaacattgtttttacctcgctgggttggtggcctatgaacaacatgattcccagttggcggtggcccgtttgacgcaggggttggcctttgcgactacacacgattcacactacatgctggccaatatttatcagttgatggcgcaactcgcaatggcggcgggggagactgccacggcgcgggttgccagtcaacggtcacaagttttcaaagacctgtttaaagaacaaattaacgaccgcctgtaaattatcagtattctgattttatgttggcgtccccaccgtgtattttataagcaccaactaaatacatgtgcacttgatctaatgggcccgttattgatttggagtggttggccgtaataacgatgaccgggttaggatgaacattgggggttataaaatgacaacagcattatttaccaatcaagtattaacacaggcaactccagcaacggtgcgagcattgctagcagatccgctgaacttaccagcatgggcgactgccattaccacggtcaagccaaccgcgacggggtacgtgttacagcggtccgattcggcttttgatcagccggaacagttgcgggttacagtcggcgctgaccaggtcgtttatcacggtgagggtggccaattgggatatgaaattgtgttcaccatgacgccattggccgagcgaactgcggtccaggaagaagtctccttacgactacaccgccgagctggctgccgttgccactagtgaagcccgtcatgcaacgagactttcagcggaagttgggtcaattggcaacattagcggaggaacagccgaatgacgattaatgatgggatgacgttaataaaagtgttagtgacgtggtggtctgtcagttggttattacgggccactttgatcggcgttgttggaataattgcctatcgttttttgaagcagcgtcaatttaagtgagttaagacgatgacagcttttatgcctaatatctaatcgtaactattattatttagtgtgcgtttaactatcatccgaaaactaattccggtattctatgggtattcttttgaaggaggaaatctcatgaatcaaccagaattacgtgacccacgctatttatataagacagatggctttgataagcaggatcaggagacacccgcactacaagctaagatgcgtcctgaacctgattgtggtgagaagagttaccaaggacatgataagttgttgaatcgacgcgttttgatcacgggtggtgattcgggaattggccgggctaccgcgattgcttttgcgcgggaaggtgctgatgttgcgattcagtacttgcaccccgccgggagaggagccggatgctgaggcggttgccgaactagtgcgcgctgcgggccgtcaagcgttattattaccttgtgatttcaaggatgttgacgttgtgaccgacctcgtggaccggacaatcgctgaatttggtggtatcgacacccttgtcctaaatgcgggacaacagatttcacaaccttcactggctaagctgccgatcgaacaggtgcgtgcgaccttcgaagtgaatatcgtcgcgatgtttgcgttagctcaggcggccttgccaaagatgcccgctggcagtagcatcgtcaccacgacttcgattcaagcctatgcgccgagtggtcatctattagattatgctgcgactaaggcggccatcaagaactttacgattaatttagcagccgaagcggccgaaaaggggattcgggtcaatggcgttgctcccgggccaatctggacgcccctacaattagatcaaggccagccaatcgaggcgctgccgaagtttggccaagataccttgcttaaacgagcgggacaacccgcagaactagcaccagtgtacgtctttttagcttctaacgacgcgagctatgtgaccgcgcaaatttatggcgtgactggtggcggcgtgattaattaggtgttcactgcaagttaattcctggttggcttgaataaatcataagtggctaccttggatggatgcattcaaggtagccactttagtgtgtttaatgatctgatgaggcgttcattaagtagtccagcgctgccgttcccaccgctttggctgcaattagtaaacagtcttcattcatcataaaatcagggctgtggtgcgggtgggtctcacccggagctgtttgacagccggcatagataaaggtgctgggtttggcttgtgcaaaataggcgaagtcctccgaggggtcttgggggccgcagtcgaaaattttagtgatttctgggatttgagcggcttgaatactggtgatgaacgcgctgtgtcagggttgcatcattcatgagtaccggataattatcatcgtaatcaagtgcaacttggacaccgaaagtcgccccgacgccgttcgcaattttagtaatctggtcacggatggtctggcgcgtggtttcgtccataatccgtacatcgcccttgagggtgacttgcgctttgatcgcattgaaggaaccgacgccgtcgaatgagccgatggtgacactgccggtatcaaatgggtcaatccggcgggaaacaacggtttgtaaggcggtcacaaagtaacttccagcaacgattgcatcgtttgagaggtggggcatcgaggcgtgcccacccttacccgtgaaggtgaccgtaaagttagcccgcccggtctgcgtcgcatttaagtgataggcgatcgagcccgtcggcatggtactcatcacatgcagcccaatgacgttatcgatgccgtctaggacgccagcagccaacatccccttagcaccaacccggtgatacttcttcagcgggttggtggataatgcggacgcgaccacgtagctgatttttcagtccgagtaaggtcttcgccagtaccatgagataagcagtatgaccatcgtgaccacaggcgtgcatgacattggcgttttgcgatttaaatgataagtggttgtcttcttgaatcgcgaggccgtcaaaatcagcgcgtaatgctaactgaggtccagggtgaccgctatcgatgtcgacgacgaagccgtacccatcaccataagcagtggttgagacgcccagttcacgatagaacgctttgatgtaagctgcggtttgttcttcatgaaatgaaatctcggggtgggcgtgtaagtggcgacgaatcttgatcatttccggttccgccgccgtgagttgttgcatgagttgtgcttgaagggtcattagaatcttcctttctgatgctagaagcgagtatattataaatatagctgagagatgatagtacttgggcactaatctttagcttagcatgaaatggcggttaataggtatcaatgtaactatggaattttcggacgcttttttaagtagtggataataactaaaaggaatattctgcattgctcatgtcctagtaagatattagatagccgctccaagaatcgtgtctgcaattcttggagcggctattttttagtcgattcaaacatatagtgtttcttaataacaacgttgaaggcgcttttgtgaaagcttagaagttcgtcacctgtttgatattaacctttaaaggtggtaattgaactgcctgactggtttttttattcgtaactctctgcgtgacagttaagccacgggtgctatttttgatttttgcatttggaataaatacttttgtagtcgcacttgcgttcttgatggttttaattacttgaccgttttgtgcaatattgatggttgcatctcgagaaccgataagcgtgtaatagatacctttggttgttcgcctctcggcactagtgactttaacctttggggttgcgtattgttgggacggaattgtggctagcacctgttgccctttcattaatttgaaatctccgtagcccttaaactgctgtgcaaacttgaattgtcctgatttgacgttgacgattcgaactttttgccttgataagttagcgtgaggtgttcgattccaatcgcgcgaccctttagtatcaaggagtgtgattgtgaactgtaattagttgtgatatttgtaatcttaggttgtacatgaagatattcggttacagtgatgatttctccgggattatttggaacactatcaaaagtggtagtcgtggcataacgagccttcataccattaatatcgcaggcttgaatagtatagtaccggtttgctggattcattacagatacactatcagtattattgtgcccaattcccagagcatgacctaattcatgctctgcaacattggtacgttctgctttggtataactttatatttttcaaataccgctcggttgatgcgaactttgcttgaagtgatttcgccagtagatttattataggaaactgaattgtagccggccagagtcatgtcagaacttccatcatacgaagaaacggtggtttttgctgtagctgctttcgtccacgtaaaaccagcctttttccaagaagcagttgcgttgttccatacatctttatagtagtcggaggatgataaatcttgatagtttgccgcttgtttatcatatcgataacctaacatcggagtggtagcttttgttgatgcgttggcacttagcagtccaaaactagttgtcaaggaaatcgtcgcaagtgttgaaaagattcttttggaaagcgcattgtaagttcccccttttaacgatatttcttatagatgaaatgaattgaacggcgggcaaatatttgcaatattaaacgacaggtagtatcaattttttctcgagatgaaaattgatgtttataaaaatacagaaggcataatgcgatttgtatttatttagtacaagtattatatcatcttggatgttccgtgaaaaaaatactgtatagtaaataacttatactaatttttaagcgctttatataaatcaatttgtatctttacataatttatcagagcggaggaaagatattgctcccacacatactgaattattatcatcgtaatctgtttttgcaaaagatatgatatattgattgtcctgactgttaatttcaggtaccctaaacaggagaccacaattatgaggaggaacgattgatgaagattttgatgccatattttaagcggtatcgactagacgtctggattgcgatgttgtcggtcatcgtcttagtgtttgcgacgttatggcaaccgcgattattgcaagtcattatggaagctattatcaagaatgatcaggctacggtattccgtgaaggactgatgttgcttggcttggccgtactgggaatcattggttgggatcgtgaatacgatatacgcagcccgggtggcccttggtgtggcgaccgacttgcgagctgacctatacgctaaggtccagtcattagcctacgctgacgtggaaaaattttcaccgtccaacttagtggtacgaatgacgaacgatattaatcaagtccaacagattgtgatggctggctttcagcagattacccggattccattactattcatcggggcactgattctcgctgtgatgacgatgcctgagcagtggtgggtcattgttgtcatgatggcggtaatcttaggggtcgcactgattgcggtgcggcgaatgactaaatactttgcacaaacgcaacaagatattgaaaacgttaatacggttgcccgcgaaaacttaatggggattcgggttgttaaatcgtttgttcaagaaccaaacgagattaaaaagttttcggccgcatccgatgaattaaccgctgtgaccgctaaaattgggtactggctttcgctattctaatgccagcgttctttttgacggccaacgtggcggtcggggtcgccgtttacttggtcggtcaaacgattacgacgcacccggcctatttagcagctattacgagttttatttcttatttaatgcagattttatttgccgtgatcaacggggatttctcatgacttttgcgtcgcgggccgtcatctcacttggtcgaatcggcgaagtgatgactaccgaaccaagtatgacctacgttgatggcgacgcggcgcccgtagctggtgatattcactttgaccacgtaaccttcacttatccgggagatgcgcagccaacgctaaaagatgtgacctttacggtaaaagcggggtccatgctgggaatcgttggggccactggatctggtaagacgacgttggcccagctgattgcgcgcttgtatgatccggatagtgggacggtctccatcggtggaattgatgtgcgggccttaccagaaaaaagccccttcgatccacggtggcctatgtcttacaacggtccacgttattttctggcacgattgcgggtaacttacggcaagttaagccggacgcccagcctagtcacatgcaatgggcggctaatattgcgcagtctgcggaattcattgaacggttgccacagacgtacgatgcccccgtggaagaacggtcacagaacttttcgggtggtcagaagcagcgactagcgattacgcgtggcgtaattgccaatccagaaatcttgattttagatgatgcgacttcggcactcgatgcgcgttcagaaaaacttgttcaggaagctttggatcgcgagttgaagtcaacgacgaccgtggtcattgccgaaaaaattgcttcaattattcgtgcggatcaaatcttagtgttagataatggtcgcatttcgggccaggggactcaccacgaattgcttcaagatagtgcgatttatcgcgctatttaccaaacgcaaaaagcacgtattacgggaggagggcttacatgagtgatttacgcaatgctggtaaatattactggcactatttaaaacgctactggttaggcttcttactaagtgtgattctgattgccttttcgacttggtgcattgtggtcgcaccgacttatctgggacgagccgtggaggagctgacgcagtacttgcagcagtggacgaatcaagcgactcgggcacaagcaagcttgcaaccgttcaaccggaccctgatcatctacgtcttgttgtatgtcggtgatgctagcacgatttttattgcgagcttgatcttagcacgcgtgacggccttttcgaccgggacaatgcgggtaggcctatttcggaagatgcaacggatgaaggttcaatactttgatacgcatagtgacggggatattctggctcggttcacctctgacctagataatatttttaatgccatgaatcaagccttgctagaaattttattagccgtggctcagtttgttggcacgctaattgtgatgtttaatcaaaatactacgatggcgtgggtgacgatggcttctacgccggttgcattaattatcgcggcgtttgtcatgcacaaggctggcgtcgcggtgaaccaacaacaggatgatatcggtcaactgaatggttatatcaatgaacaaattaccggtcaaaaagtcttgattaccaacggcttacagcaggactccttgaaaggctttcatcagtataatggtaaggttcgccagtcagcgttgacgggtcaaatctggtcaggtattttgaatccactgatgcaagggatgtcactgcttaacacggcaattgtcatcttctttggctcatggttagcgctgaatgggagtatgtcgactggagcagctttggcgctggtcgtggtgttcgttaactacgcccaacagtactaccagccaattatgtcattgactagtttatatagtatgattcagttagcgattactggtgcacggggctcgggtcgatgaagtccgtaatcaaccggatgaagtgagccccgctaacggtcaagcgctcgacgggattcatgatgaattactgattgataatgtgcgctttagttacttaccaggtaaagaaatcttgcatggcgtgtcgatccatgtgcaccgcggtgagatggtggcactcgttggcccaactggttcggggaaaacgacggtcatgaatttgttgaatcgcttctatgatgttgatagtggtgcgattacgtttgatggggtgaatattcaagactttgatctccaggtgctacggcaaaatgtcgggattgtcttacaggaaccccagttgtttacgggcacgattgcggataatattcgttacggggacccaacggctagtatggatcgggtcatcgatgcggcgaagcaggctaatattcatgactttgtgatgagcacgccagatggctatcagacgcgcgtttccgacgaacagagtatttttctgcttggtcaaaagcagttgatgtcaattgcccggacgattttaacaaatcccaagttgctgattttggatgaagcgacttcgaacgttgatacggtgacggaagccaatattcaagccgcaatggacaacgtcatccaagggcgaaccagctttgtcattgctcaccgcttgaaaacaatcctgaatgccgataaaatcgttgtattgaaggatggtcaaattattgaacaggggaaccaccatgatttattagcggcaaacggcttctatgcggaactgtatcgtaatcagatggtctttgagtaatgaaagtataaggagtcggacatggcggggcaagagcaacaagtgcgggtttcaatcccagtctcagcattaaaacgagccgggattgatcgcgatgatcagttacagttaaaggtgcgcaatgacgcactagtcttagagaagattaagccacgtcaaccacagtggcagcaatacttgataatctggccgctggttggttgcaatcctatcggggttagccagttacgggtactggtggtttcaaaaagtgcgaccagttccactgacaggtgcgcaatcaatcgggagtttgacgattgtggctggtgtggttaccggcgcagtgctatttgtcggctttttcttaaaaacgcgtaatgatccagaaaatcgattttcgcgccatatttattggcggaactttccagttattacgattgcgtttattatgatcttagcctttgcgctggtcggggctttctgggtattagaattattatttccagatgtcatcttcgatcgctttacatctatgttgctactggtcttgtttacgtattttgcggatgcgttcatgattagcgctgcgttgacgataaatgcgcggtcgttatcaacgattttaacggtggtgattgtcagtggctgtgttatctcaatggccgccaatggtcaacggcgatggtggcagcataatttaagctttttagggacgcatgccgctgaaaatgcctggcaattcaacttgacactgatttttttcggcgttattgatggtcgttctgattgactatctatttgtttcacttagtcgaatttatccgcgtacttggcgaacgtcaaccttgcggatattgttgacgttgaccgctgtcgatttcggggcggtcgggctatttcctaacaacctgacgtttcactggttacatgacttagttgctggtggcttggtcacgttgttagtctttttgattgtgggggtgcggtggctattaccagccgtgacgaaagattttctgtggctctcatacggcgttggcgtggtgctattactactcaactttggttttcgctggtttgggtatccatcgctgacggcatttgagattcaagcctttgcgatttcgtttggctggttgctgatgctattttcacgtctacaagcgttagtcaatgaagacccggaattgttgacgattaagttggagcaggaaagtacggcaggacaataagtgccacgttgttttgaaacggtggctgagtatattaataataattgaatcagataaaactggctgctagacacggtttaaagtgtctagcagccagttttattaattatggatgattgttgaagcgggttaggtgtaattgattacttttaaatgttcacatttagcgatgctgagccatcaatttgacttgtggcaacatgttatcagtgcccggttgagcaataccaaggctggtattttcgtatgctgttggctcagcaataatcttcatgattaaatcagcaatactagcacgtgaaatcatggttcctttgaagcgttcacctttgtaagtcagttcatagtcaattttggtatcgtcggtcatataggccgcgcgaataattgtagcaggaatatccgatgattcaattattctggccgcatgtcgcgtatcgtttttagcagcgtgaccgactacctgttcgacccaagcgccaaatggattaggggtttcgtggtagagtccggatcctgtgacccaaataagatggggcacatgattgcgattcattgacgtgataatggtctgtgccaataatgccatattcccggctagatttgcatagacgatatcctgattaggcataacagtgtctagtagctgtgaatcactgacatcaccttgaataaccgtttctcgttctggtgaagtgactagtaggcgccccgcatttcttaagactagtgtcaactggacgtcagtttcggctaagagtcgttgttccacaatccgcgcaattcgaccgttagcccctaaaattaaaaccttggtcattctgatcctcctcgtattagtgaatagtgtaaccaccgtcaacagcgacggcttgaccaaccatgtaactggcagcatcactgcaaagaaagagtacgacttgagcgacttcttctggtttagctaaacgccccatgggaatttcgcggactaggtcgtcccatctcctgtcgttcagtatcatccattcgggcaaccattggtgtatcaatgattcctggacacacggcgttgatccgaacattccggtcagcgtattctaaggcgctactctttgtcaggcctaagacgccgtgctttgaagcgtggtaggcagttcgatcagcaataccaacgagaccacccattgaagaacagtttacgattgcggctggtgttccctgagcacgcatctgtcgtaattcgtacttcatactgagaaacatgccttttaagttagtatccatgacatgatcatattcttcaaccgatagatcggcggtataggtgactggactttgaatcccagcatcgttataagcatagtcgaggtgcccaaactgagcaactgcgaatttcaccattccggcgacgtctttgggatcagcgacgttacacttgaatgaaacggctgagtagccatgatcgactagctgttgggcttcgtctttaggttccatgatggccagctaaaatgacgtgagcacactgctttggcgaatagagtggcagcactcaggccgattcccgtgcgtgcacctgtaacaataacgactttatctgtaaaattgaacatgactttctctccttaattaatcttcttcaaactgcattttaatatttcttgatgaacggaattgtttcaaatcgccagcattaatgtgaccaattttttgaaggttactaatcacttcgccagtttgctcataaaaatcactaagctgtgtcgcggtgtccagtaggcgatatcaccaactgcatagccagtagtgtgtgcctcgttagcggggagtgcccgctgaaaacgatacgtcaattcacggttataaaggttgagcatcggcagtgttagtggtagttgtgaaagtaacgctgcggtggtggcattttcttccaaatttgctgtgaagtggcggtcgttggctgttatcttcattttcttcattatctagtacctccctaagccaatgcgttatattcgtcattactaacgggtgatagccattctggtgtgcctgcagtgatggcaatgtgactgaaccaactatctttagtagcaccgtgccagtgtttgataccgtcatgggtgatcaccacatcaccaggatgtaatcgctgtgccggttgcccggcttcttggtaccagccttcgccaccagtgactaataagatttgatagccattgtgatggatatgccagttgttacgggctccgggttcaaagctgacgttgctgacagttacgttgacttgctcgtctttcactagagagttgtggtaacttttaccggtaaagtattgttgaaaagcaacgtttaaatctcccattgcaaaaatgccgtgttggacgctattttcattattgttcattgttaaaaacacctttcatttaaaattaattgtgggctaaaatttgaagctcggcttttgttagtacgtttcccactagttgttcacggaagtcgttgtaatagaagcggttattcaacggcaagttgtgcttgagtgcaaatacggatagtgtatatcgatgaggctgatcaggtggattcggtccggcatagtgatcggcgaaatacgaatcgtttaactgataaaagcgtgacatccatgagttttgaccttgggggccctcaaaattacgactgaaatcggctgggatttctgccatgacaggaatattggtcgcgagccagtgaatgaacggaaaacccgttcgtgggacggcgtcgtaatcaatgagcgaaatagcaaacgcagtcgttattgcaggaattgatttgatttcaattggaaacaatagaatcggttggcctgagtgtttgacgttcgcgttactggtatagattagtggtaaaaagccatcgtctaaatcaactttaatttgcattaaaccgacctcctagtaaaaaccaggtttgttccaagcagtattgggttcagcgacgccagtatgctacttcgctgatataattggggattgtgaataatttcagtaatcaggtcagcaacggcttggcgtgtcaccgcgtatctttgaatggcatcccctgaggaatgaccttgtagtccgtatgctggtcattattatatagccaggccattcttaaaaatgtatagttcagtccactattatcaatcacggcagcagctcgcttgatttcagtataat
